(12) United States Patent
Lamb et al.

(10) Patent No.: US 9,708,589 B2
(45) Date of Patent: Jul. 18, 2017

(54) COMPOSITIONS AND METHODS FOR CUSTOM SITE-SPECIFIC DNA RECOMBINASES

(71) Applicant: Monsanto Technology, LLC, St. Louis, MO (US)

(72) Inventors: Jonathan C. Lamb, Wildwood, MO (US); Artem G. Evdokimov, Foristell, MO (US)

(73) Assignee: Monsanto Technology LLC, St. Louis, MO (US)

(*) Notice: Subject to any disclaimer, the term of this patent is extended or adjusted under 35 U.S.C. 154(b) by 353 days.

(21) Appl. No.: 14/109,823

(22) Filed: Dec. 17, 2013

(65) Prior Publication Data

US 2014/0193915 A1 Jul. 10, 2014

Related U.S. Application Data

(60) Provisional application No. 61/789,302, filed on Mar. 15, 2013, provisional application No. 61/739,008, filed on Dec. 18, 2012.

(51) Int. Cl.
| | |
|---|---|
| *C12N 9/12* | (2006.01) |
| *C07K 14/47* | (2006.01) |
| *C12N 15/82* | (2006.01) |
| *C12N 15/90* | (2006.01) |

(52) U.S. Cl.
CPC ........ *C12N 9/1241* (2013.01); *C07K 14/4705* (2013.01); *C12N 15/8213* (2013.01); *C12N 15/902* (2013.01); *C07K 2319/00* (2013.01)

(58) Field of Classification Search
None
See application file for complete search history.

(56) References Cited

U.S. PATENT DOCUMENTS

| | | | |
|---|---|---|---|
| 6,580,019 B1 | 6/2003 | McElroy et al. | |
| 6,750,379 B2 | 6/2004 | McElroy et al. | |
| 7,919,321 B2 | 4/2011 | Flasinski | |
| 8,450,107 B1* | 5/2013 | Zhang .................. | C12N 5/0686 435/325 |
| 2001/0056583 A1 | 12/2001 | McElroy et al. | |
| 2005/0060769 A1 | 3/2005 | Gilbertson | |
| 2008/0178348 A1 | 7/2008 | Gilbetson | |

(Continued)

FOREIGN PATENT DOCUMENTS

WO    WO 01/66780    9/2001

OTHER PUBLICATIONS

U.S. Appl. No. 14/209,731, filed Mar. 13, 2014, Chomet et al.

(Continued)

*Primary Examiner* — Robert Mondesi
*Assistant Examiner* — Richard Ekstrom
(74) *Attorney, Agent, or Firm* — Dentons US LLP; Amanda Carmany-Rampey

(57) ABSTRACT

The invention relates to biotechnology and provides novel compositions and methods for sequence-specific or sequence-directed transcription activator-like effector recombinases. The invention also provides novel plant transformation vectors and expression cassettes, which include novel combinations of chimeric recombinases with plant expression and transformation elements. Methods for gene-targeting, DNA sequence removal, and molecular breeding are also provided.

24 Claims, 14 Drawing Sheets

(56) References Cited

U.S. PATENT DOCUMENTS

| | | |
|---|---|---|
| 2011/0126310 A1 | 5/2011 | Feng et al. |
| 2011/0145940 A1 | 6/2011 | Voytas et al. |
| 2011/0239315 A1 | 9/2011 | Bonas et al. |
| 2011/0301073 A1 | 12/2011 | Gregory et al. |
| 2012/0110685 A1 | 5/2012 | Bonas et al. |
| 2012/0178131 A1 | 7/2012 | Voytas et al. |
| 2012/0178169 A1 | 7/2012 | Voytas et al. |
| 2012/0192301 A1 | 7/2012 | Jaenisch et al. |
| 2012/0214228 A1 | 8/2012 | Voytas et al. |
| 2012/0222143 A1 | 8/2012 | Fahrenkrug et al. |
| 2013/0137173 A1* | 5/2013 | Zhang .................. C12N 15/63 435/375 |
| 2014/0283166 A1 | 9/2014 | Chomet et al. |
| 2015/0167010 A1 | 6/2015 | Lamb et al. |
| 2015/0203871 A1* | 7/2015 | Juillerat .................. C12N 9/22 435/462 |
| 2015/0218230 A1* | 8/2015 | Juillerat ............... C12N 15/102 530/350 |
| 2015/0284728 A1* | 10/2015 | Barbas, III ............... C12N 9/16 435/199 |

OTHER PUBLICATIONS

U.S. Appl. No. 14/209,828, filed Mar. 13, 2014, Lamb et al.
Akopian et al., "Chimeric recombinases with designed DNA sequence recognition;" Proc Natl Acad Sci USA 100(15):8688-91, 2003.
Boch et al., "Breaking the code of DNA binding specificity of TAL-type III effectors," Science 326:1509-1512, 2009.
Bogdanove et al., "TAL Effectors: Customizable Proteins for DNA Targeting," Science 333:1843-1846, 2011.
Broothaerts et al., "Gene transfer to plants by diverse species of bacteria," Nature 443(7026):629-633, 2005.
Bruce et al., "Influence of retinoblastoma-related gene silencing on the initiation of DNA replication by African cassava mosaic virus Rep in cells of mature leaves in Nicotiana benthamiana plants," Virol J. 8:561, 2011.
Buchholz et al., "In vitro evolution and analysis of HIV-1 LTR-specific recombinases," Methods 53(1):102-109, 2011.
Deng et al., "Structural Basis for Sequence-Specific Recognition of DNA by TAL Effectors," Science 335:720-723, 2012.
Dhar et al., "Architecture of the Hin Synaptic Complex during Recombination," Cell 119(1):33-45, 2004.
Gaj et al., "Structure-guided reprogramming of serine recombinase DNA sequence specificity," Proc Natl Acad Sci USA 108(2):498-503, 2011.
Garcia-Otin et al., "Mammalian genome targeting using site-specific recombinases," Frontiers in Bioscience 11:1108-1136, 2006.
Gelvin, "Agrobacterium-Mediated Plant Transformation: the Biology behind the 'Gene-Jockeying' Tool," Microbiology and Molecular Biology Reviews 67(1):16-37, 2003.
Gersbach et al., "Directed evolution of recombinase specificity by split gene reassembly," Nucleic Acids Res 38(12):4198-4206, 2010.
Gordley et al., "Evolution of programmable zinc finger-recombinases with activity in human cells," J Mol Biol 367(3):802-13, 2007.
Gordley et al., "Synthesis of programmable integrases," Proc Natl Acad Sci USA 106(13):5053-5058, 2009.
Grindley et al., "Mechanisms of site-specific recombination," Annu Rev Biochem 75:567-605, 2006.
Hellens et al., "Technical Focus: A guide to Agrobacterium binary Ti vectors," Trends in Plant Science 5(10):446-451, 2000.
Hughes et al., "Sequence-specific interaction of the Salmonella Hin recombinase in both major and minor grooves of DNA," EMBO J. 11(7):2695-2705, 1992.
Iida et al., "A tale of two integrations, transgene and T-DNA: gene targeting by homologous recombination in rice," Current Opinion in Biotechnology 15(2):132-138, 2004.
Mak et al., "The Crystal Structure of TAL Effector PthXo I Bound to Its DNA Target," Science 335:716-719, 2012.
Mercer et al., "Chimeric TALE recombinases with programmable DNA sequence specificity," Nucleic Acids Res 40(21):11163-72, 2012.
Miki et al., "Procedures for introducing foreign DNA into plants," In: Methods in Plant Molecular Biology and Biotechnology, Glick et al. (Eds.), pp. 67-88, 1993.
Miller et al., "A TALE nuclease architecture for efficient genome editing," Nat Biotechnol 29(2):143-8, 2011.
Mor et al., "Geminivirus vectors for high-level expression of foreign proteins in plant cells," Biotechnol Bioeng. 81(4):430-7, 2003.
Moscou et al., "A Simple Cipher Governs DNA Recognition by TAL Effectors," Science 326:1501, 2009.
Nagy, "Cre recombinase: The universal reagent for genome tailoring," Genesis 26(2):99-109, 2000.
Nern et al., "Multiple new site-specific recombinases for use in manipulating animal genomes," Proc Natl Acad Sci USA 108(34):14198-203, 2011.
Proudfoot et al., "Zinc finger recombinases with adaptable DNA sequence specificity," PLoS One 6(4):e19537, 2011.
Rimphanitchayakit et al., "Saturation mutagenesis of the DNA site bound by the small carboxy-terminal domain of gamma delta resolvase," EMBO J. 9(3): 719-725, 1990.
Schornack et al., "Gene-for-gene-mediated recognition of nuclear-targeted AvrBs3-like bacterial effector proteins," J Plant Physiology 163(3):256-272, 2006.
Smith et al., "Diversity in the serine recombinases," Molecular Microbiology 44(2):299-307, 2002.
Sun et al., "Optimized TAL effector nucleases (TALENs) for use in treatment of sickle cell disease," Mol Biosyst 8(4):1255-63, 2012.
Szurek et al., "Type III-dependent translocation of the Xanthomonas AvrBs3 protein into the plant cell," Mol Microbiol 46(1):13-23, 2002.
Torney et al., "Mesoporous silica nanoparticles deliver DNA and chemicals into plants," Nature Nanotechnology 2:295-300, 2007.
Turan et al., "Site-specific recombinases: from tag-and-target- to tag-and-exchange-based genomic modifications," FASEB Journal, 25:4088-4107, 2011.
Tucker et al., "Riboswitches as versatile gene control elements," Current Opinion in Structural Biology 15(3):342-348, 2005.
Vergunst et al., "VirB/D4-Dependent Protein Translocation from Agrobacterium into Plant Cells," Science 290(5493):979-982, 2000.
Willment et al., "Identification of long intergenic region sequences involved in maize streak virus replication," J Gen Virol. 88:1831-1841, 2007.
You et al., "Use of Bacterial Quorum-Sensing Components to Regulate Gene Expression in Plants," Plant Physiology 140(4):1205-1212, 2006.
Zhu et al., "Cleavage-dependent ligation by the FLP recombinase. Characterization of a mutant FLP protein with an alteration in a catalytic amino acid," J. Biol Chem, 270(30):23044-23054, 1995.
USPTO: Non-Final Office Action regarding U.S. Appl. No. 14/209,828, dated Feb. 9, 2017.

* cited by examiner

COMPOSITIONS AND METHODS FOR CUSTOM SITE-SPECIFIC DNA RECOMBINASES

CROSS-REFERENCE TO RELATED APPLICATIONS

This application claims the benefit of U.S. provisional applications 61/789,302 filed Mar. 15, 2013, and 61/739,008 filed Dec. 18, 2012, which are incorporated herein by reference in their entirety.

INCORPORATION OF SEQUENCE LISTING

The sequence listing that is contained in the file named "MONS313US-corrected ST.txt", which is 753KB (measured in MS-WINDOWS) and created on Mar. 10, 2014, is filed herewith by electronic submission and incorporated herein by reference.

BACKGROUND OF THE INVENTION

Field of the Invention
The invention relates to the field of biotechnology.
Description of Related Art
Site-specific recombination has tremendous potential for application across a wide range of biotechnology-related fields. Zinc finger nucleases (ZFNs) are synthetic proteins, containing a DNA-binding domain and a DNA-cleavage domain, that have been successfully used to enable genome editing. Zinc finger recombinases (ZFRs) are made by fusing a recombinase catalytic domain to the N-terminus of a zinc finger (Akopian et al., 2003). Zinc fingers (ZFs) are just one among many different protein folds that enable proteins to bind DNA in a sequence-specific manner. Unfortunately, DNA targeting using zinc fingers is still limited by the difficulty in engineering novel DNA sequence specificities and site-specific recombination in unmodified genomes is only possible if recombinases can be designed to recognize endogenous target sequences with high specificity.

DNA-binding domains from transcription activator-like effector (TALE) proteins have a significant advantage over ZF domains as TALE protein DNA-binding domain specificity is determined by a straight-forward cipher allowing for the design of custom DNA-binding proteins.

BRIEF SUMMARY OF THE INVENTION

In one aspect, the present invention provides a chimeric recombinase polypeptide including a serine recombinase catalytic domain and a TALE DNA-binding domain including at least one repeat-variable di-residue (RVD) DNA-binding repeat domain. In one embodiment, the chimeric recombinase polypeptide includes a linker between the catalytic domain and the TALE DNA-binding domain. In particular embodiments, the linker comprises at least 2 amino acids.

In some embodiments, the chimeric recombinase polypeptide includes the serine recombinase catalytic domain at the N-terminal position. In other embodiments, the serine recombinase catalytic domain can be a small serine recombinase catalytic domain. In yet other embodiments, the serine recombinase catalytic domain can be a permissive small serine recombinase catalytic domain. In certain embodiments, the serine recombinase catalytic domain includes a recombinase selected from the group consisting of Gin20H106Y, GinL7C7-EE2, GinL7C7-EE3, HinB (Hin106Y), and HinC.

In one embodiment, the chimeric recombinase includes the TALE DNA-binding domain at the C-terminal position. In yet another embodiment, the chimeric recombinase includes the first amino acid of the TALE DNA-binding domain beginning at about 125, 128, 135, 145, 155, 165, 180, 190, 200, 210, 220, 230, 240, 245, 250, or 260 amino acids upstream from the first amino acid of the first RVD repeat of the TALE DNA-binding domain. In further specific embodiments, the chimeric recombinase includes the first amino acid of the TALE DNA-binding domain beginning at 53, 81, 85, 98, 102, 113, 117, 130, 136, or 147 amino acids upstream from the first amino acid of the first RVD repeat of the TALE DNA-binding domain.

In certain embodiments, the present invention provides a chimeric recombinase including a permissive recombinase domain at the N-terminal position. A permissive recombinase domain is able to catalyze recombination of many different recombinase core sequences including recombination between two different recombinase core sequences. At the most extreme, a fully permissive recombinase would be able to cause recombination between any two sequences. In the case of a fully permissive recombinase, all the specificity of the enzyme would be caused by the DNA-binding domains.

In one non-limiting embodiment, the recombinase comprises a small serine recombinase catalytic domain of GinL7C7-EE2 at the N-terminal position. In another embodiment, the chimeric recombinase polypeptide includes a polypeptide linker of 13 amino acids between the TALE DNA-binding domain and the serine recombinase catalytic domain. In still another embodiment, the chimeric recombinase polypeptide includes a TALE DNA-binding domain at the C-terminal position, wherein the first amino acid of the TALE DNA-binding domain begins 136 amino acids upstream from the first amino acid of the first at least one RVD repeat of the TALE DNA-binding domain.

In another aspect, the present invention provides an isolated nucleic acid sequence encoding a chimeric recombinase DNA recombination target sequence comprising, in a 5' to 3' orientation, a first TALE binding site. In some embodiments, the isolated nucleic acid sequence encoding a chimeric recombinase DNA recombination target sequence includes a first spacer sequence. In certain embodiments, the isolated nucleic acid sequence encoding a chimeric recombinase DNA recombination target sequence includes a serine recombinase core sequence. In other embodiments, the isolated nucleic acid sequence encoding a chimeric recombinase DNA recombination target sequence includes a second spacer sequence. In yet another embodiment, the isolated nucleic acid sequence encoding a chimeric recombinase DNA recombination target sequence includes a second TALE binding site.

In particular embodiments, the first TALE binding site can include an adenine deoxyribonucleotide base in the last position of the first TALE binding site. In some embodiments, the second TALE binding site can include a thymine deoxyribonucleotide base in the first position of the second TALE binding site.

In certain embodiments, the recombinase core sequence includes at least 8, 10, 12, 14, 16, 18 or more nucleotides. In other embodiments, the first and second spacer sequence includes 0, 1, 2, 3, 4, 5, 6, 7, 8, 9, 10, 11, 12, 13, 14, 15 or more nucleotides. In yet another embodiment, the first and second spacer sequences include a same number of nucleotides. In some embodiments, the first and second spacer sequences include a different number of nucleotides.

In yet another aspect, the present invention provides a chimeric recombinase polypeptide dimer including a first chimeric recombinase polypeptide binding with a first chimeric recombinase DNA recombination target sequence; wherein the first chimeric recombinase polypeptide includes a serine recombinase catalytic domain and a TALE DNA-binding domain including at least one RVD DNA-binding repeat domain. In some embodiments, the chimeric recombinase polypeptide dimer includes a second chimeric recombinase polypeptide binding with a second chimeric recombinase DNA recombination target sequence, wherein the second chimeric recombinase polypeptide includes a serine recombinase catalytic domain and a TALE DNA-binding domain including at least one RVD DNA-binding repeat domain. In certain embodiments, the first chimeric recombinase polypeptide and the second chimeric recombinase polypeptide form a dimer. In other embodiments, the first chimeric recombinase polypeptide comprises a polypeptide linker. In yet other embodiments, the second chimeric recombinase polypeptide comprises a polypeptide linker.

In an additional aspect, the present invention provides a chimeric recombinase polypeptide tetramer including a first pair of chimeric recombinase polypeptides binding with a first chimeric recombinase DNA recombination target sequence, wherein each of the chimeric recombinase polypeptides of the first pair of chimeric recombinase polypeptides includes a serine recombinase catalytic domain and a TALE DNA-binding domain including at least one RVD DNA-binding repeat domain. In particular embodiments, the chimeric recombinase polypeptide tetramer includes a second pair of chimeric recombinase polypeptides binding with a second chimeric recombinase DNA recombination target sequence, wherein each of the chimeric recombinase polypeptides of the second pair of chimeric recombinase polypeptides includes a serine recombinase catalytic domain and a TALE DNA-binding domain including at least one RVD DNA-binding repeat domain. In one embodiment, the first pair of chimeric recombinase polypeptides and the second pair of chimeric recombinase polypeptides form a tetramer. In other embodiments, the chimeric recombinase polypeptides of the first pair of chimeric recombinase polypeptides comprises a polypeptide linker. In yet other embodiments, the chimeric recombinase polypeptides of the second pair of chimeric recombinase polypeptides comprises a polypeptide linker.

In a certain aspect, the present invention provides a method of gene-targeting including binding a chimeric recombinase DNA recombination target sequence with at least two chimeric recombinase polypeptides, wherein each of the chimeric recombinase polypeptides includes a serine recombinase catalytic domain and a TALE DNA-binding domain including at least one RVD DNA-binding repeat domain. In some embodiments, the method includes each of the chimeric recombinase polypeptides including a polypeptide linker.

In one aspect, the present invention provides a method of gene-targeting including binding a first pair of chimeric recombinase polypeptides with a first chimeric recombinase DNA recombination target sequence, wherein each of the chimeric recombinase polypeptides of the first pair of chimeric recombinase polypeptides includes a serine recombinase catalytic domain and a TALE DNA-binding domain including at least one RVD DNA-binding repeat domain. In certain embodiments, the method includes binding a second pair of chimeric recombinase polypeptides with a second chimeric recombinase DNA recombination target sequence, wherein each of the chimeric recombinase polypeptides of the second pair of chimeric recombinase polypeptides includes a serine recombinase catalytic domain and a TALE DNA-binding domain including at least one RVD DNA-binding repeat domain.

In one embodiment, the method includes the first pair of chimeric recombinase polypeptides and the second pair of chimeric recombinases polypeptides forming a tetramer. In another embodiment, the method includes the tetramer mediating recombination between the first and the second chimeric recombinase DNA recombination target sequences. In particular embodiments, the method includes each of the chimeric recombinase polypeptides of the first pair of chimeric recombinase polypeptides including a polypeptide linker. In some embodiments, the method includes each of the chimeric recombinase polypeptides of the second pair of chimeric recombinase polypeptides including a polypeptide linker.

In particular embodiments, the serine recombinase catalytic domain is positioned at a C-terminal position of the chimeric recombinase polypeptide. In one embodiment, the DNA construct encoding the chimeric recombinase polypeptide includes a nucleic acid sequence encoding a first polypeptide linker between the TALE DNA-binding domain and the serine recombinase catalytic domain.

In some embodiments, the TALE DNA-binding domain is positioned at an N-terminal position of the chimeric recombinase polypeptide. In other embodiments, the DNA construct encoding the chimeric recombinase polypeptide includes a nucleic acid sequence encoding a non-specific DNA-contact domain polypeptide positioned at the C-terminus of the serine recombinase catalytic domain. In yet other embodiments, the DNA construct encoding the chimeric recombinase polypeptide includes a nucleic acid sequence encoding a second polypeptide linker between a C-terminus of the serine recombinase catalytic domain and an N-terminus of the non-specific DNA-contact domain.

In certain embodiments, the first linker includes at least 2 amino acids. In one embodiment, the first linker includes SEQ ID NO:77 or SEQ ID NO:78. In one embodiment, the second linker includes at least 2 amino acids. In yet another embodiment, the second linker comprises SEQ ID NO:79. In further specific embodiments, the DNA-contact domain is selected from the group consisting of SEQ ID NO:80, SEQ ID NO:81, SEQ ID NO:82, and SEQ ID NO:83.

In other embodiments, the serine recombinase catalytic domain positioned at the C-terminal position of the chimeric recombinase polypeptide begins 0 to 160 amino acids upstream from a first amino acid of a first at least one RVD DNA-binding repeat domain. In yet another embodiment, a first amino acid of the TALE DNA-binding domain begins 53, 81, 85, 98, 102, 113, 117, 130, 136, or 147 amino acids upstream from a first amino acid of a first at least one RVD DNA-binding repeat domain. In some embodiments, a first amino acid of the TALE DNA-binding domain begins 136 amino acids upstream from a first amino acid of a first at least one RVD DNA-binding repeat domain. In one embodiment, the serine recombinase catalytic domain is positioned at the C-terminus of the TALE DNA-binding domain.

In some embodiments, the serine recombinase catalytic domain positioned at a C-terminal truncation site of the TALE DNA-binding domain. In certain embodiments, the C-terminal truncation site is selected from the group consisting of SEQ ID NO:84, SEQ ID NO:85, and SEQ ID NO:86.

In one non-limiting embodiment, the method of gene-targeting includes N-TALERs as the first and second pairs of chimeric recombinase polypeptides. In another embodiment, the method of gene-targeting includes C-TALERs as the first and second pairs of chimeric recombinase polypeptide. In still other embodiments, the method of gene-targeting includes N-TALERs or C-TALERs as the first pair of chimeric recombinase polypeptides, and N-TALERs or C-TALERs as the second pair of chimeric recombinase polypeptides.

In another aspect, the present invention provides a method of gene-targeting in a cell including introducing one or more chimeric recombinase polypeptides and one or more gene-targeting donor constructs into a cell. In particular embodiments, the gene-targeting donor constructs include one or more TALER recombination sites. In certain embodiments, a recombinase core sequence of one or more of the TALER recombination sites differs by 0, 1, 2, 3, 4, 5, 6, 7, 8, 9, 10, 11, 12, 13, 14, 15, 16, 17, or 18 bp as compared to a recombinase core sequence in a genome of the cell.

In other embodiments, the recombinase core sequence of one or more TALER recombination sites of the gene-targeting donor construct, or the recombinase core sequence in the genome of said cell, includes a native or perfect Gin recombination core sequence. In particular embodiments, the recombinase core sequence of one or more TALER recombination sites of the gene-targeting donor construct, or the recombinase core sequence in the genome of the cell, includes at least a 12 bp pseudo-palindrome sequence, including two 5 bp sequences flanking a central di-nucleotide site of recombination. In other embodiments, the recombinase core sequence of one or more TALER recombination sites or the recombinase core sequence in the genome of said cell consists of SEQ ID NO:290.

In some embodiments, the recombinase core sequence of one or more TALER recombination sites or the recombinase core sequence in the genome of said cell is selected from the group consisting of SEQ ID NOs:285, 286, 287, 288, and 289. In yet other embodiments, the recombinase core sequence of one or more recombinase target sites of the gene-targeting donor construct, or the recombinase core sequence in the genome of said cell, includes at least a 8 bp pseudo-palindrome sequence. In certain embodiments, the 8 bp pseudo-palindrome sequence includes two 3 bp sequences flanking a central di-nucleotide site of recombination.

BRIEF DESCRIPTION OF THE DRAWINGS

The following drawings form part of the present specification and are included to further demonstrate certain aspects of the present invention. The invention may be better understood by reference to one or more of these drawings in combination with the detailed description of specific embodiments presented herein.

FIG. 7: Sequencing results for colony PCR products generated from a white colony expressing sN-TALER IV-1 and Gin18TALE+1, or sN-TALER IV-1 and Gin20TALE+0, or sN-TALER IV-1 and Gin20TALE+10 reporter constructs.

FIG. 8: Sequencing results for colony PCR products generated from colonies expressing N-TALER reporters Gin18TALE+0, Gin20TALE+5, and Gin20TALE+10, co-transformed with pN-TALER IV-1-EE2.

DETAILED DESCRIPTION OF THE INVENTION

Figure 1:
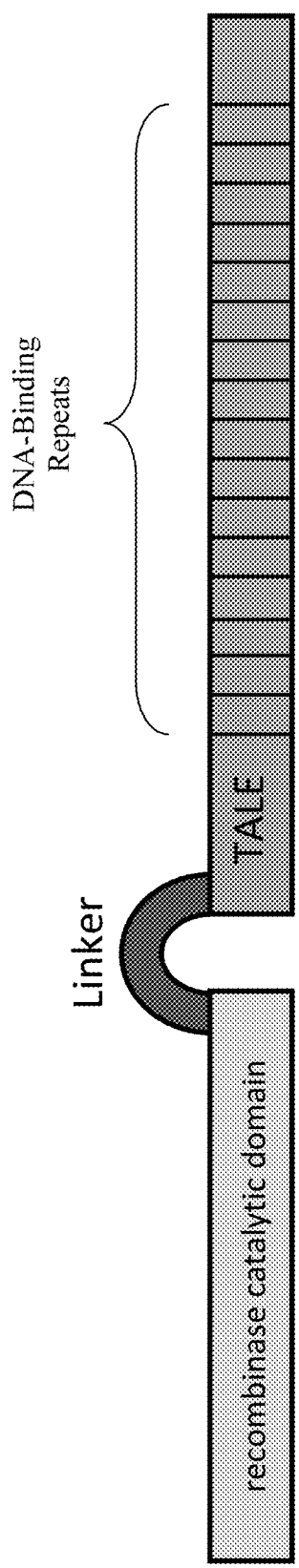
FIG. 1: A schematic representation of a chimeric N-terminal transcription activator-like effector recombinase protein (N-TALER); a hyperactive recombinase catalytic domain from the family of small serine recombinases (also known as the resolvase/invertase family) tethered by an optional polypeptide linker of variable length, tethered to the N-terminus of a TALE protein.

The present invention provides for the use of sequence-specific and/or sequence-directed recombinases for the modification of a target organism genome by manipulating the location and frequency of genetic recombination in a cell of the organism. Transcription activator-like effectors (TALEs) are DNA-binding proteins that recognize DNA in a modular fashion using a well described structural specificity thereby enabling customizable DNA targeting (Moscou and Bogdanove, 2009; Boch et al., 2009). Thus, the invention provides vectors and expression cassettes encoding combinations of sequences encoding TALE recombinases (TALERs). A nucleic acid sequence to be targeted by a TALER comprises another aspect of the invention. Methods for causing a TALER to modify a target genome are also contemplated. The genomic complement of an organism modified by the use of such a TALER is also contemplated. The invention thus provides tools and methods that allow one to insert, remove, or modify genes, loci, linkage blocks, and chromosomes within an organism.

TALE nuclease (TALEN) fusion proteins have been described that are capable of creating site-specific DNA double-strand breaks which can enable DNA sequence modifications at the break site (reviewed in Bogdanove and Voytas, 2011). Transcription activator-like effector recombinases (TALERs) are made by fusing a recombinase catalytic domain to the N-terminus of a TALE protein. Use of fusion proteins containing DNA-binding domains and enzymatic domains is described, for example, in U.S. Patent Application Publication Nos. 2012/0222143, 2012/0214228, 2012/0192301, 2012/0178169, 2012/0178131, 2012/0110685, 2011/0301073, 2011/0239315, and 2011/0145940, which are incorporated herein by reference in their entirety.

Testing Strategies for TALERs

The invention provides novel uses for sequence-specific or sequence-directed TALERs for molecular breeding by providing a genomic nucleic acid sequence to be targeted by at least one such TALER, wherein the genomic nucleic acid sequence is native or transgenic. In addition, TALERs can be customized to catalyze recombination between one or more recognition sequences. In certain embodiments, such a custom TALER would have properties making it amenable to genetic modification such that the enzyme's recognition, binding and/or recombinase activity could be manipulated.

One aspect of this invention is to introduce into a cell a non-naturally occurring sequence-specific or sequence-directed TALER to modify the cell in such a way that the cell will subsequently confer a beneficial trait in the cell, or in an organism comprised of such cells. In one non-limiting example, the cell is a plant cell and the trait is a trait such as improved yield, quality or agronomic performance. The ability to generate such a cell, or organism derived therefrom depends on introducing the TALER using transformation vectors and cassettes described herein.

Recombinases are enzymes that catalyze DNA exchange reactions between target site nucleic acid sequences (see, e.g., Nern et al., 2011; and reviewed in Garcia-Otin and Guillou, 2006; and Turan and Bode, 2011). Examples of recombinases are well known in the art and can include, for instance, Cre recombinase (see, e.g., Nagy, 2000), Tre recombinase (see, e.g., Bucholz and Hauber, 2011), Flp recombinase (Zhu and Sadowski, 1995), and Hin recombinase (see, e.g., Dahr et al., 2004).

The modular nature of many proteins, recombinases included, allow for the use of common molecular biology techniques to redesign such proteins. Native serine recombinase catalytic domains have their own target DNA sequence specificity. Recognition of a recombinase-specific DNA sequence is necessary for the enzyme to properly target its intended function. As such, contiguous fragments of some recombinases, for example small serine recombinases, have been identified which encode for the catalytic recombinase domain. However, even after the DNA-binding domain is replaced, such a recombinase retains some DNA-binding capability as required for its catalytic recombinase activity. Thus, the resulting recombination site recognized by the catalytic recombinase domain is a composite of the core catalytic DNA target sequence of the recombinase catalytic domain and any binding sites recognized by potential protein fusion partners.

Zinc finger recombinases (ZFRs) are fusions between zinc finger (ZF) DNA-binding domains and a hyperactive catalytic domain from a serine recombinase. ZFs functionally replace the native DNA-binding domain of the serine recombinase thereby changing the target sequence that the recombinase will bind and act on. Molecular evolution techniques have been used to alter the recombinase domains to change or remove their specificity. When the recombinase domain has relaxed specificity, it is able to recombine sites with different core sequences. For a recombinase domain with little or no specificity, the recombination activity would be directed to a specific sequence exclusively by the flanking ZFs.

A variable number of imperfect amino acid repeats controls TALE DNA-binding specificity (Schonack et al., 2006). Polymorphisms at repeat positions 12 and 13 (termed the repeat-variable di-residue, or RVD) directly determine which nucleotide is recognized. Various combinations of amino acid pairs located at this position correspond in a one-to-one manner (one RVD to one nucleotide) with a nucleotide targeted for binding by a TALE DNA-binding domain containing the requisite RVD (Moscou and Bogdanove, 2009; and Boch et al., 2009). As such, the TALE DNA-binding domains provided herein can recognize a specific nucleotide sequence of interest within a target DNA.

The DNA-binding domain of a TALE protein can include multiple DNA-binding repeats. Each DNA-binding repeat recognizes a single base pair within a target DNA sequence, and each DNA-binding repeat can include a RVD which is responsible for recognizing a single base pair in a target DNA sequence. RVD amino acid pair combinations that recognize a nucleotide include: histidine-aspartic acid (HD) for recognizing cytosine (C); asparagine-glycine (NG) for recognizing thymine (T); asparagine-isoleucine (NI) for recognizing adenine (A); and asparagine-asparagine (NN) for recognizing guanine (G). Additional specificities for the RVD amino acids in positions 12 and 13 and the corresponding target DNA base pair have been reported (Boch et al., 2009; and Moscou and Bogdanove, 2009).

TALERs cleave then re-ligate DNA at or near a target sequence in a target genome that exactly matches or is closely related to a specific recognition sequence. In one embodiment, the TALERs have a restricted number of recombination sites per target DNA, including, for example, a plasmid or other type of vector, or a genome. In a particular embodiment, the TALER mediates recombination at a single site in the genome. A TALER that mediates recombination between two specific recognition sequences, such that the recognition sequence is less likely to occur often within a target DNA, including but not limited to a genome, may be particularly useful. In another embodiment, the TALER mediates recombination between two recognition sequences greater than 14 nucleic acid bases. It is recognized that the longer the recognition sequence, the less likely it is that the TALER attempt recombination more than once in the target genome.

In one embodiment, an effective TALER comprises at least the minimal portion of a TALE required for DNA-binding linked to a recombinase domain. Defining the minimal DNA-binding domain can be done empirically by making a series of truncations to a functional TALE.

In the case of TALERs with the recombinase fused to the N-terminus of the TALE, any of the many possible truncations of the C-terminus that retains robust DNA-binding activity would be acceptable and functionally equivalent. However, at the N-terminus, the truncation position can affect the positioning of the recombinase relative to the DNA-binding site. Therefore, some N-terminal truncation positions may produce TALERs with essentially equivalent DNA-binding properties but different recombination frequencies due to the intersection of TALER DNA-binding and positioning of the catalytic activity of the recombinase domain. However, in cases where attachment of the recombinase to the N-terminus of a truncated TALE does not augment TALE binding, N-terminal truncations must not be so extensive that TALE binding is impaired. In cases where attachment of the recombinase to the N-terminus of a truncated TALE does augment TALE binding, even more extensive truncations may function. Thus, experiments looking at the minimal N-terminus for TALE binding to DNA can be used to choose a range of truncation points to attach recombinases.

In particular embodiments, a TALER can include a nonpermissive recombinase to mediate recombination between one or more recognition sequences. Such a specific TALER would have properties making it amenable to genetic modification such that its recognition, binding and/or recombinase activity could be manipulated.

Molecular evolution techniques have been used to alter recombinase catalytic domains to change or remove their specificity. When the recombinase domain has relaxed specificity, it is able to recombine sites with different DNA recognition sites. For a recombinase domain with little or no specificity, the recombination activity is permissive, and would be directed to a specific DNA sequence with the assistance of another DNA-binding protein. In another embodiment of the invention, a permissive recombinase is directed to a target sequence on a nucleic acid molecule by linking the recombinase to a sequence specific TALE DNA-binding protein or molecule. As an example, a TALE DNA-binding domain may be used to direct a permissive recombinase to a recognition site (i.e., "recognition sequence") within a target sequence (see, e.g., U.S. Patent Application Publication No. 2012/0110685 and 2012/0178169). Other types of catalytically active recombinases that would be suitable for use with this invention include catalytically active small serine recombinases, large serine recombinases, or tyrosine recombinases. In certain embodiments, these recombinases can have sequence specificity and built in DNA-binding activity. Ideally, a molecular breeder of, for example, plants, mushrooms, or animals, would have at his or her disposal a range of TALERs by which to induce sequence- or site-specific recombination events at, or linked to, defined sites within nucleic acid molecules or whole genomes.

In some embodiments, the recombinase catalytic domain can be tethered by an optional polypeptide linker of variable length to the N-terminus of a TALE protein (N-TALER). In other embodiments, the recombinase catalytic domain can be tethered by polypeptide linker of variable length to the C-terminus of a TALE protein (C-TALER). A unique advantage of C-TALER chimeras is that these allow for a wider selection of putative TALE targeting sequences in a host genome relative to the selection of TALE targeting sites for N-TALER chimeras. This wider selection of putative TALE targeting sites with C-TALER chimeras is due to the less restrictive orientation of TALE binding sites in a TALE targeting sequence for C-TALERs. In particular, the TALE binding site of a C-TALER monomer can be variable lengths allowing the central sequence between the two TALE binding sites to be varied. In contrast, N-TALERs have a requirement of a TALE binding site which is bounded by the first nucleotide flanking the N-TALER central sequence which should be a T or less preferably a C or even less preferably a G.

C-TALERs and N-TALERs may be used together to allow the best TALE binding sites to be selected. The flexibility provided by having the option of using N-TALERs, C-TALERs or combinations of C-TALERs and N-TALERs to choose recombination sites expands the number of possible TALER recombination sites that can be effectively used and simplifies selection of desirable sites.

The present invention also provides for use of TALER-mediated recombination to genetically alter expression and/or activity of a gene or gene product of interest in a tissue- or cell-type specific manner to improve productivity or provide another beneficial trait, wherein the nucleic acid of interest may be endogenous or transgenic in nature. Thus, in one embodiment, a TALER is engineered to mediate recombination at specific sites in a gene of interest. Genes of interest include those for which altered expression level/protein activity is desired. These recombination events can be either in coding sequences or in regulatory elements.

This invention provides for the introduction of a TALER into a cell. Exemplary TALERs include natural and engineered (i.e., modified) polypeptides with recombinase activity such as recombinases possessing sequence motifs and catalytic activities of the GinH107Y, GinL7C7-EE2, and GinL7C7-EE3 variants (see Gordley et al., 2009; Gersbach et al., 2010; and Gordley et al., 2007), as well as small serine recombinases, large serine recombinases, and tyrosine recombinases, naturally occurring or engineered for a given target specificity. Contemplated recombinases include the Cre recombinase (see, e.g., Nagy, 2000), the Tre recombinase (see, e.g., Bucholz and Hauber, 2011), the Flp recombinase (Zhu and Sadowski, 1995), and the Hin recombinase (see, e.g., Dhar et al., 2004), and those recombinases known in the art.

To be effective, the catalytically active TALER must be introduced to, or produced by, a target cell. The present invention contemplates multiple strategies for delivery and expression of TALERs to cells.

Transient Expression of TALERs

In some embodiments, the TALER is transiently introduced into the cell. In certain embodiments, the introduced TALER is provided in sufficient quantity to modify the cell but does not persist after a contemplated period of time has passed or after one or more cell divisions. In such embodiments, no further steps are needed to remove or segregate the TALER from the modified cell.

In another embodiment, mRNA encoding the TALER is introduced into a cell. In such embodiments, the mRNA is translated to produce the TALER in sufficient quantity to modify the cell but does not persist after a contemplated period of time has passed or after one or more cell divisions. In such embodiments, no further steps are needed to remove or segregate the TALER from the modified cell.

In one embodiment of this invention, a catalytically active TALER is prepared in vitro prior to introduction to a cell, including a prokaryotic or eukaryotic cell. The method of preparing a TALER depends on its type and properties and would be known by one of skill in the art. For example, if the TALER is a chimeric recombinase with a catalytically active small serine recombinase domain, the active form of the TALER can be produced via bacterial expression, in vitro translation, via yeast cells, in insect cells, or by other protein production techniques described in the art. After expression, the TALER is isolated, refolded if needed, purified and optionally treated to remove any purification tags, such as a His-tag. Once crude, partially purified, or more completely purified TALERs are obtained, the TALER may be introduced to, for example, a plant cell via electroporation, by bombardment with TALER coated particles, by chemical transfection or by some other means of transport across a cell membrane. Methods for introducing nucleic acids into bacterial and animal cells are similarly well known in the art. In the case of Agrobacterium-mediated plant transformation methods, the TALER can be expressed in Agrobacterium as a recombinant protein, fused to an appropriate domain of a Vir protein such that it is transported to the plant cell (Vergunst et al., 2000). The protein can also be delivered using nanoparticles, which can deliver a combination of active protein and nucleic acid (Torney et al., 2007). Once a sufficient quantity of the TALER is introduced so that an effective amount of in vivo recombinase activity is present, the target site or sites are looped out. It is also recognized that one skilled in the art might create a TALER that is inactive but is activated in vivo by native processing machinery; such a TALER is also contemplated by this invention.

In another embodiment, a construct that will transiently express a TALER is created and introduced into a cell. In yet another embodiment, the vector will produce sufficient quantities of the TALER in order for the desired target site or sites to be effectively recombined. For instance, the invention contemplates preparation of a vector that can be bombarded, electroporated, chemically transfected or transported by some other means across the plant cell membrane. Such a vector could have several useful properties. For instance, in one embodiment, the vector can replicate in a bacterial host such that the vector can be produced and purified in sufficient quantities for a transient expression. In another embodiment, the vector can encode a drug resistance gene to allow selection for the vector in a host, or the vector can also comprise an expression cassette to provide for the expression of the TALER in an organism. In a further embodiment, the expression cassette could contain a promoter region, a 5' untranslated region, an optional intron to aid expression, a multiple cloning site to allow facile introduction of a sequence encoding a TALER, and a 3' UTR. In some embodiments, it can be beneficial to include unique restriction sites at one or at each end of the expression cassette to allow the production and isolation of a linear expression cassette, which can then be free of other vector elements. The untranslated leader regions, in certain embodiments, can be plant-derived untranslated regions. Use of an intron, which can be plant-derived, is contemplated when the expression cassette is being transformed or transfected into a monocot cell.

In other embodiments, one or more elements in the vector include a TALER target sequence. This facilitates recombination within the expression cassette, enabling removal and/or insertion of elements such as promoters and transgenes. Use of recombination to modify or delete transgenes is described, for example, in International Publication Nos. WO2001066780A3, WO2001066780A2, U.S. Patent Application Publication Nos. 2008/0178348, 2005/0060769, 2001/0056583, and U.S. Pat. Nos. 6,750,379, and 6,580,019, which are incorporated herein by reference in their entirety.

One exemplary approach to deliver a TALER in a cell would be to create a fusion protein with a virulence protein that is translocated into such a cell. Examples of virulence proteins include Agrobacterium VirD2, VirE2, VirE2 and VirF proteins. In this way, the Vir protein fused with the TALER would be transported to the target cell by the same cellular apparatus that delivers nucleic acid T-DNA strands and travel to the cell's nucleus, where the TALER would produce the desired recombination event in the genome of the cell.

In another approach, a transient expression vector may be introduced into a cell using a bacterial or viral vector host. For example, Agrobacterium is one such bacterial vector that can be used to introduce a transient expression vector into a host cell. When using a bacterial, viral or other vector host system, the transient expression vector is contained within the host vector system. For example, if the Agrobacterium host system is used, the transient expression cassette would be flanked by one or more T-DNA borders and cloned into a binary vector. Many such vector systems have been identified in the art (reviewed in Hellens et al., 2000).

In embodiments whereby the TALER is transiently introduced in sufficient quantities to modify a cell, a method of selecting the modified cell may be employed. In one such method, a second nucleic acid molecule containing a selectable marker is co-introduced with the transient TALER. In this embodiment, the co-introduced marker may be part of a molecular strategy to introduce the marker at a target site. For example, the co-introduced marker may be used to disrupt a target gene by inserting between recombination sites. In another embodiment, the co-introduced nucleic acid may be used to produce a visual marker protein such that transfected cells can be cell-sorted or isolated by some other means. In yet another embodiment, the co-introduced marker may randomly integrate or be directed via a second TALER to integrate at a site independent of the primary target site. In still yet another embodiment, the co-introduced molecule may be targeted to a specific locus via recombination between recognition sites of the TALER. In the above embodiments, the co-introduced marker may be used to identify or select for cells that have likely been exposed to the TALER and therefore are likely to have been modified by the TALER.

Stable Expression of TALERs

In another embodiment, a circular TALER vector is stably transformed into a cell so as to bind a recognition sequence at or near the target site in the host genome with a TALE DNA-binding domain as well as a recognition sequence within the vector, and the recombinase domain recombines the two recognition sequences thereby integrating the circular vector into the genome. In this embodiment, the design of the transformation vector provides flexibility for when and under what conditions the TALER is expressed. Furthermore, the transformation vector can be designed to comprise a selectable or visible marker that will provide a means to isolate or efficiently select cell lines that contain and/or have been modified by the TALER. In a certain embodiment, a linear TALER vector is stably transformed into a cell so as to bind two recognition sequences within the vector with a TALE DNA-binding domain, wherein the recombinase domain recombines the two-plasmid recognition sequences thereby circularizing the vector, after which the TALE DNA-binding domain of the TALER binds a recognition sequence at or near the target site in the host genome as well as the recognition sequence within the newly formed circular TALER vector, and the recombinase domain recombines the two recognition sequences thereby integrating the newly formed circular vector into the genome.

Cell transformation systems have been described in the art and descriptions include a variety of transformation vectors. For example, for plant transformations, two principal methods include *Agrobacterium*-mediated transformation and particle gun bombardment-mediated transformation. In both cases, the TALER is introduced via an expression cassette. The cassette may contain one or more of the following elements: a promoter element that can be used to express the TALER; a 5' untranslated region to enhance expression; an intron element to further enhance expression in certain cell types, such as monocot cells; a multiple-cloning site to provide convenient restriction sites for inserting the TALER-encoding sequence and other desired elements; and a 3' untranslated region to provide for efficient termination of the expressed transcript. For particle bombardment or with protoplast transformation, the expression cassette can be an isolated linear fragment or may be part of a larger construct that might contain bacterial replication elements, bacterial selectable markers or other elements. The TALER expression cassette may be physically linked to a marker cassette or may be mixed with a second nucleic acid molecule encoding a marker cassette. The marker cassette is comprised of necessary elements to express a visual or selectable marker that allows for efficient selection of transformed cells. In the case of *Agrobacterium*-mediated transformation, the expression cassette may be adjacent to or between flanking T-DNA borders and contained within a binary vector. In another embodiment, the expression cassette may be outside of the T-DNA. The presence of the expression cassette in a cell may be manipulated by positive or negative selection regime(s). Furthermore, a selectable marker cassette may also be within or adjacent to the same T-DNA borders or may be somewhere else within a second T-DNA on the binary vector (e.g., a 2 T-DNA system).

In another embodiment, cells that have been modified by a TALER, either transiently or stably, are carried forward along with unmodified cells. The cells can be sub-divided into independent clonally derived lines or can be used to regenerate independently derived organisms. Individual plants or animals or clonal populations regenerated from such cells can be used to generate independently derived lines. At any of these stages a molecular assay can be employed to screen for cells, organisms or lines that have been modified. Cells, organisms or lines that have been modified continue to be propagated and unmodified cells, organisms or lines are discarded. In these embodiments, the presence of an active TALER in a cell is essential to ensure the efficiency of the overall process.

Expression Strategies for TALERs

Promoters for transformation have been described in the art; thus the invention provides, in certain embodiments, novel combinations of promoters and a sequence encoding a TALER, to allow for specifically introducing a recombination event into endogenous DNA (i.e., a genome). In one embodiment, a constitutive promoter is cloned 5' to a TALER-encoding gene, in order to constitutively express the TALER in transformed cells. This may be desirable when the activity of the TALER is low or the frequency of finding and recombining the target site is low. It may also be desirable when a promoter for a specific cell type, such as the germ line, is not known for a given species of interest.

In another embodiment, an inducible promoter can be used to turn on expression of the TALER under certain conditions. For example, a cold shock promoter cloned upstream of a TALER might be used to induce the TALER under cold temperatures. Other environmentally inducible promoters have been described and can be used in a novel combination with a TALER-encoding sequence. Another type of inducible promoter is a chemically inducible promoter. Such promoters can be precisely activated by the application of a chemical inducer. Examples of chemical inducible promoters include the steroid inducible promoter and a quorum sensing promoter (see, e.g., You et al., 2006; U.S. Patent Application Publication No. 2005/0227285). Recently it has been shown that modified RNA molecules comprising a ligand specific aptamer and riboswitch can be used to chemically regulate the expression of a target gene (Tucker et al, 2005; International Publication No. WO2006073727). Such a riboregulator can be used to control the expression of a TALER-encoding gene by the addition or elimination of a chemical ligand.

In other embodiments, the promoter is a tissue specific promoter, a developmentally regulated promoter, or a cell cycle regulated promoter. Certain contemplated promoters include ones that only express in the germline or reproductive cells, among others. Such developmentally regulated promoters have the advantage of limiting the expression of the TALER to only those cells in which DNA is inherited in subsequent generations. Therefore, a TALER-mediated genetic modification (i.e., genetic recombination) is limited only to cells that are involved in transmitting their genome from one generation to the next. This might be useful if broader expression of the TALER were genotoxic or had other unwanted effects.

Another contemplated promoter is a promoter that directs developmentally regulated expression limited to reproductive cells just before or during meiosis. Such a promoter has the advantage of expressing the TALER only in cells that have the potential to pass on their genome to a subsequent generation. Examples of such promoters include the promoters of genes encoding DNA ligases, recombinases, replicases, and so on.

Tissue- and development-specific promoters are additionally useful to control gamete development and essentially create haploid material (akin to haploid induction in a double haploid (DH) plant). Another aspect of this technology that is parallel to maternal induction systems in a DH comprises use of a pollen expressed TALER that can recombine in one or more sites in the male gamete genome to disable fertilization. Conveniently, the resulting seed would thus not contain a gene product. Resulting haploid cells, haploid embryos, haploid seeds, haploid seedlings, or haploid plants can be chemically treated with a doubling agent. Non-limiting examples of known doubling agents include nitrous oxide gas, anti-microtubule herbicides, anti-microtubule agents, colchicine, pronamide, and mitotic inhibitors.

Other tissue/development specific control mechanisms include manipulating pollen delay by targeting pollen development pathway elements or cytoplasmic male sterility elements to generate male sterile plants, which has utility for eliminating manual pollination practices in breeding and manufacturing hybrid crops.

In another embodiment, the promoter can be part of a two component system and can be activated when a second component is provided. For example, the promoter may require a non-native transcription factor to bind and activate. This transcription factor may be provided by crossing to a line expressing the second component. In a further elaboration, the second component may be regulated in an environmental, tissue or developmental specific manner.

In addition to promoters, this invention provides for 5' untranslated regions, introns and 3' untranslated regions that can be uniquely combined with a TALER-encoding sequence to create novel expression cassettes with utility for genome engineering.

Transformation Methods

Methods for transforming or transfecting a cell are well known in the art. Methods for plant transformation using *Agrobacterium* or DNA coated particles are well known in the art and are incorporated herein. Suitable methods for transformation of host cells for use with the current invention are believed to include virtually any method by which DNA can be introduced into a cell (see, e.g., Miki et al., 1993), for example by *Agrobacterium*-mediated transformation (U.S. Pat. Nos. 5,563,055; 5,591,616; 5,693,512; 5,824,877; 5,981,840; 6,384,301; Gelvin, 2003; and Broothaerts et al., 2005) and by acceleration of DNA coated particles (U.S. Pat. Nos. 5,015,580; 5,550,318; 5,538,880; 6,160,208; 6,399,861; and 6,403,865), etc. Through the application of techniques such as these, the cells of virtually any species may be stably transformed.

Various methods for selecting transformed cells have been described. For example, one might utilize a drug resistance marker such as a neomycin phosphotransferase protein to confer resistance to kanamycin or to use 5-enolpyruvyl shikimate phosphate synthase to confer tolerance to glyphosate. In another embodiment, a carotenoid synthase is used to create an orange pigment that can be visually identified. These three exemplary approaches can each be used effectively to isolate a cell or multicellular organism or tissue thereof that has been transformed and/or modified by a TALER.

When a nucleic acid sequence encoding a selectable or screenable marker is inserted into a genome at the same locus as a TALER-encoding sequence or TALER target sequence, the marker can be used to detect the presence or absence of the TALER or its activity. This may be useful once a cell has been modified by the TALER, and recovery is desired of a genetically modified cell, or a regenerated organism from such a modified cell, that no longer contains the TALER. In other embodiments, the marker may be intentionally designed to integrate at the recombination site, such that it can be used to follow a modified cell independent of the TALER. The marker can be a gene that provides a visually detectable phenotype, such as in the seed, to allow rapid identification of seeds that carry or lack the TALER gene.

This invention provides for a means to regenerate an organism from a cell with a stably integrated sequence-directed recombinase. The regenerant can then be used to propagate additional organisms.

The invention additionally provides novel plant transformation vectors and expression cassettes which include novel combinations of a TALER with expression and transformation elements. The invention further provides methods of obtaining a cell, a whole plant or animal, and a seed or embryo that have been specifically modified using a TALER. This invention also relates to a novel cell or organism containing a non-naturally occurring sequence-specific or sequence-directed TALER.

Detection of Recombinase Activity and TALER-Mediated Genomic Modification in Cells The invention also provides molecular assays for detecting and characterizing cells that have been modified by a TALER. These assays include but are not limited to genotyping reactions, a PCR assay, a sequencing reaction or other molecular assay. Design and synthesis of nucleic acid primers useful for such assays, for instance to assay for the occurrence of a recombination event, are also contemplated.

Genotyping can be utilized, for instance by high throughput, non-destructive seed sampling for one or more markers, such as genetic markers. This sampling approach permits the rapid identification of seed comprising preferred or selected genotypes or phenotypic characters such that only preferred or targeted seed is planted, saving resources on greenhouse and/or field plots. Apparatus and methods for the high throughput, non-destructive sampling of seeds have been described. For example, U.S. Patent Application Publication Nos. 2006/0048247; 2006/0048248; 2006/0042527; 2006/0046244; 2006/0046264; and 2007/0204366; which are incorporated herein by reference in their entirety, disclose apparatus and systems for the automated sampling of seeds as well as methods of sampling, testing and bulking seeds.

Use of Custom TALERs in Molecular Breeding

In some embodiments, genome knowledge is utilized for targeted genetic alteration of a genome. At least one custom TALER can be designed to target at least one region of a genome to delete that region from the genome. This aspect of the invention may be especially useful for genetic alterations. The resulting organism could have a modified phenotype or other property depending on the gene or genes that have been removed. Previously characterized mutant alleles or introduced transgenes can be targeted for TALER re-design, enabling creation of improved mutants or transgenic lines.

In another embodiment, a gene targeted for deletion or disruption may be a transgene that was previously introduced into the target organism or cell. This has the advantage of allowing an improved version of a transgene to be introduced or by allowing removal of a selectable marker encoding sequence. In yet another embodiment, a gene targeted for deletion or disruption via recombination is at least one transgene that was introduced on the same vector or expression cassette as (an)other transgene(s) of interest, and resides at the same locus as another transgene. It is understood by those skilled in the art that this type of recombination may result in deletion or insertion of additional sequences. Thus it may, in certain embodiments, be preferable to generate a plurality of organisms or cells in which a deletion has occurred, and to screen such organisms or cells using standard techniques to identify specific organisms or cells that have minimal alterations in their genomes following recombination. Such screens may utilize genotypic and/or phenotypic information. In such embodiments, a specific transgene may be removed while leaving the remaining transgene(s) intact. This avoids having to create a new transgenic line containing the desired transgenes without the undesired transgene.

In another aspect, the present invention includes methods for inserting a nucleic acid of interest into a specific site of an organism's genome, wherein the nucleic acid of interest is from the genome of the organism or is heterologous with respect to the organism. This invention allows one to select or target a particular region of the genome for nucleic acid (i.e., transgene) stacking. A targeted region of the genome may thus display linkage of at least one transgene to a haplotype of interest associated with at least one phenotypic trait, and may also result in the development of a linkage block to facilitate transgene stacking and transgenic trait integration, and/or development of a linkage block while also allowing for conventional trait integration. In another embodiment of this invention, a pair of sequence specific TALERs may be used to move a sequence specifying an allele contained on a specific locus within one linkage block contained on one chromosome to the same locus within a different linkage block on the homologous chromosome. Progeny containing the transferred allele in the new linkage context may exhibit one or more different traits, depending on the transferred allele and the alleles on the new linkage block.

For instance, a TALER that is specific for, or can be directed to, a recognition sequence that is upstream of the locus containing the non-target allele is selected. A second TALER that is specific for, or can be directed to, a recognition sequence that is downstream of the target locus containing the non-target allele may also be selected. The TALERs can be selected such that they recombine in regions where there is no homology to the non-target locus containing the target allele. Both TALERs are cloned into expression cassettes and introduced into a cell using one of the methods described above. Once introduced, the TALERs are expressed based on the properties of the promoter and other regulatory elements found in each expression cassette that comprises a TALER-encoding sequence. The TALERs can then be expressed, and can recombine upstream and downstream of the target locus, respectively.

Use of TALERs in Trait Integration

Directed insertion via custom TALERs for at least one recognition sequence in the genome, allows for targeted insertion of multiple nucleic acids of interest, i.e., a trait stack, to be added to the genome of a plant or animal, in either the same site or different sites. Sites for targeted integration can be selected based on knowledge of the underlying breeding value, transgene performance in that location, underlying recombination rate in that location, existing transgenes in that linkage block, or other factors. Once the stacked organism is assembled, it can be used as a trait donor for crosses to germplasm being advanced in a breeding pipeline or be directly advanced in the breeding pipeline.

The present invention includes methods for inserting at least one nucleic acid of interest into at least one site, wherein the nucleic acid of interest is from the genome of an organism, such as a QTL or allele, or is transgenic in origin. A targeted region of the genome may thus display linkage of at least one transgene to a haplotype of interest associated with at least one phenotypic trait (as described in U.S. Patent Application Publication No. 2006/0282911), development of a linkage block to facilitate transgene stacking and transgenic trait integration, development of a linkage block to facilitate QTL or haplotype stacking and conventional trait integration, and so on.

In another embodiment of this invention, a pair of sequence-specific TALERs can be used to move an allele at a specific locus within one linkage block contained on one chromosome to the same locus within a different linkage block on the homologous chromosome by making use of knowledge of genomic sequence information and the ability to design custom TALER TALE DNA-binding domains as described in the art. A TALE DNA-binding domain that is specific for, or can be directed to, a recognition sequence that is upstream of the locus containing the non-target allele is selected from a library of TALE DNA-binding domains or engineered as necessary. A second TALE DNA-binding that is specific for, or can be directed to, a recognition sequence that is downstream of the target locus containing the non-target allele is also selected or engineered. The TALERs may be selected such that they bind in regions where there is no homology to the non-target locus containing the target allele. Both TALERs may be introduced into a cell using one of the methods described above.

In another aspect, this technology enables the identification of the one or more loci in a genome to be used for transgene insertion. Site-directed integration allows the comparison of one or more transgenes inserted in the same position across multiple germplasm as well as comparison of different expression elements in a transgenic construct. For example, 10, 100, 1000, 10,000 or 100,000 custom TALERs can be generated and used for target integration of at least one construct. The recognition sequence for a TALER can be artificially introduced into the genome and resulting events can be screened or multiple custom TALE DNA-binding domains for corresponding unique recognition sequences can be generated.

At least one expression construct encoding at least one nucleic acid of interest may be evaluated for position effects to determine a preferred location for integration of sequences of that construct, thus allowing for enhanced breeding efficiency, including more efficient trait integration than the current state of the art that typically relies on random integration, and thus does not allow for such controlled testing and comparison. In addition, by being able to target a given insertion site or locus of interest, variations of a given recombinant construct designed to insert into or otherwise manipulate genomic nucleic acid sequence at the locus of interest, and for instance comprising alternate genetic regulatory elements such as an alternate promoter or terminator, may then be tested at the given locus. The described methods thus further allow for the above multivariate experiments to be conducted across germplasm, wherein position effects, promoter effects, and so on are tested in at least two different germplasm entries. Custom TALERs allow testing for the identification of identified insertion sites for the performance of one or more transgenes. Methods and compositions relating to breeding for improved transgene performance are provided in U.S. Patent Application Publication No. 2009/0031438, which is incorporated herein by reference. Custom TALERs enable experiments to compare different insertion sites as well as different construct design at the same insertion site, further facilitating development of germplasm-transgene combinations for enhanced transgene performance.

Further, as described herein, this process can be conducted simultaneously or serially with manipulation of the DNA repair/recombination pathways to increase the efficiency of targeted insertion.

The ability to execute targeted integration relies on the action of the TALE DNA-binding domain and the recombinase domain of the TALER. This advantage provides methods for engineering organisms of interest, including a plant or animal or a cell, comprising at least one genomic modification.

The present invention also contemplates that one or more genetic elements involved in DNA repair, recombination, or meiosis may be manipulated using gene suppression, transgenic expression constructs, and/or at least one other TALER to target the at least one genetic element. This strategy can direct the outcome of the TALER-induced recombination event to favor targeted integration or deletion. Once the action of the TALER has occurred, the result is a non-naturally occurring modified cell. Organisms derived from and/or containing this cell can thus display a trait of interest, such as enhanced yield, quality or agronomic performance.

In the course of using TALERs to target insertion to specific sequences, coupling targeted integration with recombination control permits the rapid generation of inbreds, eliminating the need for selfing or recurrent selection. The methods of this invention also enables trait integration on segregating material, saving time and resources in a breeding program and enabling rapid development of sister lines. Steps may include, but are not limited to, the use of a positive-negative selection system (Lida et al., 2004) or suppression of certain pathway genes. Methods for overexpression or suppression are known to those skilled in the art.

In another aspect, the present invention provides methods for controlling the rate of recombination in the genome of a crop plant. In one embodiment, recombination rate for at least one genomic region of interest is increased in order to increase the number of potential recombinants at the genomic region.

In another embodiment, recombination is inhibited thus fixing the genome of an organism in one step. In a particular embodiment, recombination is inhibited after targeted insertion of one or more nucleic acids of interest, as enabled by an engineered TALER (i.e., a custom TALE DNA-binding domain fused to a recombinase). This can be accomplished, for instance, by co-transformation or by achieving directed recombination via action of a TALER, and subsequently by administration of recombination and/or meiosis inhibition agents, such as a transgenic approach based on manipulation of a gene involved in meiosis or DNA repair. This combination of technologies provides a strategy for "instant" trait integration.

This present invention combines tools for site-directed gene integration as well as manipulation of recombination rate (i.e., inhibition or enhancement), for instance enabling rapid trait integration wherein recombination is inhibited by suppression or elimination of one or more elements of meiosis or by using approaches, such as production of a dihaploid, to rapidly generate an inbred or homozygous line displaying a trait of interest. Trait integration, especially for two or more traits, is time consuming and resource intensive. The present invention advances the state of the art of transgenic breeding by combining methods for recombination inhibition with methods for directed recombination, i.e., targeted gene integration.

A custom TALER can be utilized to generate at least one trait donor to create a custom transgenic event that is then crossed into at least one second organism of interest, including a plant or animal, wherein TALER delivery can be coupled with the at least one nucleic acid of interest to be inserted. In other aspects one or more organisms of interest are directly transformed with the TALER and at least one nucleic acid of interest for directed insertion. It is recognized that this method may be executed in various cell, tissue, and developmental types, including gametes. It is further anticipated that one or more of the elements described herein may be combined with use of promoters specific to particular cells, tissues, organs and/or development stages, such as a meiosis-specific promoter.

In certain aspects, the TALER and recombination inhibition elements are delivered simultaneously though not necessarily expressed simultaneously. Alternatively, the site-directed integration and recombination inhibition elements are delivered separately. In addition, any of the steps described above may be carried out at any stage of development, including gametes, embryos, cell culture, other tissues, and organisms. In certain aspects, cells are provided that have been modified to confer an improved trait. Taken together, the invention enables a plant or animal breeder to use new tools and efficiencies for manipulating a genome within a germplasm pool.

In addition, the invention contemplates the targeting of a transgenic element already existing within a genome for deletion or disruption. This allows, for instance, an improved version of a transgene to be introduced, or allows selectable marker removal. In yet another embodiment, a gene targeted for deletion or disruption via recombination is at least one transgene that was introduced on the same vector or expression cassette as (an)other transgene(s) of interest, and resides at the same locus as another transgene. In one embodiment, the transgene(s) can be deleted through the action of TALERs, as described above, independent of homologous recombination pathways.

In one aspect, the invention thus provides a method for modifying a locus of interest in a cell comprising (a) identifying at least one locus of interest within a DNA sequence; (b) creating a modified nucleotide sequence, in or proximal to the at least one locus of interest, that includes a recognition sequence for a first recombinase according to the invention; (c) introducing into at least one cell the recombinase, wherein the recombinase is expressed transiently or stably; (d) assaying the cell for a recombinase-mediated modification in the DNA making up or flanking the locus of interest; and (e) identifying the cell or a progeny cell thereof as comprising a modification in said locus of interest.

Further provided is a method for modifying a locus of interest in a cell comprising (a) identifying at least one locus of interest within a DNA sequence; (b) creating a modified nucleotide sequence at the locus of interest, in or proximal to the at least one locus of interest, that includes a recognition sequence for a first chimeric recombinase according to the invention; (c) introducing into at least one cell the chimeric recombinase, wherein the chimeric recombinase is expressed transiently or stably; (d) assaying the cell for a modification caused by the chimeric recombinase in the DNA sequence making up or flanking the locus of interest; and (e) identifying a cell or a progeny cell thereof as comprising a modification in said locus of interest.

A third aspect provides a method for modifying a locus of interest in a cell comprising (a) identifying at least one locus of interest within a DNA sequence; (b) identifying at least one chimeric recombinase recognition sequence within the at least one locus of interest; (c) introducing into at least one cell at least one chimeric recombinase according to the invention, wherein the cell comprises the recognition sequence in or proximal to the locus of interest and the chimeric recombinase is expressed transiently or stably and creates modified site that includes at least one recognition sequence for the chimeric recombinase; (d) assaying the cell for a chimeric recombinase-mediated modification in the DNA making up or flanking the locus of interest; (e) identifying a cell or a progeny cell thereof which comprises a modified nucleotide sequence at said locus of interest and (f) introducing into the at least one identified cell at least another chimeric recombinase which recognizes the modified nucleotide sequence at the locus of interest.

The invention further provides a method comprising one or more steps subsequent to step (f), wherein the locus which comprises the sequence recognized by this other chimeric recombinase is further modified. Thus sequential modification of a locus of interest, by two or more chimeric recombinase according to the invention, is contemplated, and genes or other sequences added by the action of such a first chimeric recombinase may be retained, further modified, or removed by the action of a second chimeric recombinase. Sequences, including modified sequences, at a locus of interest may also be modified or removed, or alternatively retained, during subsequent breeding or other crop development activities, for instance with or without further use of a chimeric recombinase.

Definitions

The definitions and methods provided define the present invention and guide those of ordinary skill in the art in the practice of the present invention. Unless otherwise noted, terms are to be understood according to conventional usage by those of ordinary skill in the relevant art. Definitions of common terms in molecular biology may also be found in Alberts et al., Molecular Biology of The Cell, 5th Edition, Garland Science Publishing, Inc.: New York, 2007; Rieger et al., Glossary of Genetics: Classical and Molecular, 5th edition, Springer-Verlag: New York, 1991; King et al, A Dictionary of Genetics, 6th ed., Oxford University Press: New York, 2002; and Lewin, Genes IX, Oxford University Press: New York, 2007. The nomenclature for DNA bases as set forth at 37 CFR §1.822 is used.

As used herein, "domain" refers to a polypeptide that includes an amino acid sequence of an entire polypeptide or a functional portion of a polypeptide. Certain functional subsequences are known, and if they are not known, can be determined by truncating a known sequence and determining whether the truncated sequence yields a functional polypeptide.

As used herein, "TALE protein" refers to a transcription activator-like effector (TALE) protein or a homolog thereof. TALE proteins were originally identified as a virulence factor from the phytopathogenic bacterial genera *Xanthomonas* or *Ralstonia*. TALE proteins bind DNA in the nucleus, via a domain of DNA-binding repeats, where they act as transcriptional activators thereby contributing to virulence.

As used herein, "TALER site" or "TALER recombination site" refers to a sequence that comprises a TALER central sequence and can be recombined by a TALER or a set of TALERs.

As used herein, "TALE DNA-binding domain" refers to the domain of a TALE protein, or chimeric TALE-recombinase (TALER) protein, that binds to a specific DNA sequence, defined herein as a "TALE binding site" (TBS), via a domain of DNA-binding repeats. As used herein, "DNA-binding repeat" refers to a sequence containing a variable number (typically 34) of amino acids, typically found in the context of an imperfectly repeating set. Each DNA-binding repeat can include hypervariable amino acid residues, defined herein as "repeat-variable di-residues" (RVDs), typically at positions 12 and 13.

As used herein, "TALER" refers to a chimeric protein which combines at least a first hyperactive recombinase catalytic domain from a recombinase tethered, by an optional polypeptide linker of variable length, to the N- or C-terminus of a TALE protein.

As used herein, "recombinase core sequence" is defined as the essential recombination-site DNA sequence minimally required for recognition as a substrate for a recombinase catalytic domain. As used herein, "TALER target sequence" refers to a nucleic acid sequence encoding a TALE binding site followed by an optional spacer followed by a recombinase core sequence followed by a spacer sequence followed by a TALE binding site.

As used herein, "TALER central sequence" refers to a nucleic acid sequence flanked by TALER binding sites. In some embodiments, the TALER central sequence contains a recombinase core sequence with flanking, adjoining, spacers. In other embodiments, the TALER central sequence of one TALER site does not contain a recombinase core sequence but can be recombined with a second TALER site that does contain a recombinase core sequence.

As used herein, "TALER expression construct" refers to a DNA construct that includes an encoded chimeric TALER protein that can be transcribed.

As used herein, "TALER reporter construct" refers to a DNA construct that includes synthetic TALER target sequences where two TALE binding sites, flanking a recombinase core sequence, are oriented such that the recombinase domains of the TALER proteins, when bound to the DNA, will be positioned at the recombinase core sequence between the two TALE binding sites (Table 1). In certain embodiments, the TALER reporter constructs described herein include a recombinase core sequence, that is recombined by the native Gin recombinase, and a 5' and 3' spacer sequence (Table 1).

As used herein, "spacer" refers to a nucleotide sequence between a TALE binding site and a recombinase core sequence (Table 1).

As used herein, "linker" refers to an amino acid sequence tethering the recombinase catalytic domain to the TALE protein.

As used herein, "perfect Gin recombinase sequence" refers to a recombinase core sequence that is efficiently recombined with itself by a permissive or stringent, hyperactive Gin recombinase. As used herein, "native Gin recombinase sequence" refers to all or part of the sequence that is the natural target of recombination of the Gin recombinase or a variant of that sequence where the central di-nucleotide site of recombination is AT, AA, or TT.

As used herein, "exogenous DNA sequence" refers to a DNA sequence that originates outside the host cell. Such a DNA sequence can be obtained from a different species, or the same species, as that of the cell into which it is being delivered.

A palindromic sequence is a nucleic acid sequence that is the same whether read 5' to 3' on one strand or 3' to 5' on the complementary strand with which it forms a double helix. A nucleotide sequence is said to be a palindrome if it is equal to its reverse complement. A palindromic sequence can form a hairpin. Thus, as used herein, a "pseudo-palindrome sequence" refers to an imperfect palindromic sequence wherein not all the nucleic acid base pairs obey a hairpin two-fold symmetry.

In some embodiments, numbers expressing quantities of ingredients, properties such as molecular weight, reaction conditions, and so forth, used to describe and claim certain embodiments of the present disclosure are to be understood as being modified in some instances by the term "about." In some embodiments, the term "about" is used to indicate that a value includes the standard deviation of the mean for the device or method being employed to determine the value. In some embodiments, the numerical parameters set forth in the written description and attached claims are approximations that can vary depending upon the desired properties sought to be obtained by a particular embodiment. In some embodiments, the numerical parameters should be construed in light of the number of reported significant digits and by applying ordinary rounding techniques. Notwithstanding that the numerical ranges and parameters setting forth the broad scope of some embodiments of the present disclosure are approximations, the numerical values set forth in the specific examples are reported as precisely as practicable. The numerical values presented in some embodiments of the present disclosure may contain certain errors necessarily resulting from the standard deviation found in their respective testing measurements. The recitation of ranges of values herein is merely intended to serve as a shorthand method of referring individually to each separate value falling within the range. Unless otherwise indicated herein, each individual value is incorporated into the specification as if it were individually recited herein.

In some embodiments, the terms "a" and "an" and "the" and similar references used in the context of describing a particular embodiment (especially in the context of certain of the following claims) can be construed to cover both the singular and the plural, unless specifically noted otherwise. In some embodiments, the term "or" as used herein, including the claims, is used to mean "and/or" unless explicitly indicated to refer to alternatives only or the alternatives are mutually exclusive.

The terms "comprise," "have" and "include" are open-ended linking verbs. Any forms or tenses of one or more of these verbs, such as "comprises," "comprising," "has," "having," "includes" and "including," are also open-ended. For example, any method that "comprises," "has" or "includes" one or more steps is not limited to possessing only those one or more steps and can also cover other unlisted steps. Similarly, any composition or device that "comprises," "has" or "includes" one or more features is not limited to possessing only those one or more features and can cover other unlisted features.

All methods described herein can be performed in any suitable order unless otherwise indicated herein or otherwise clearly contradicted by context. The use of any and all examples, or exemplary language (e.g., "such as") provided with respect to certain embodiments herein is intended merely to better illuminate the present disclosure and does not pose a limitation on the scope of the present disclosure otherwise claimed. No language in the specification should be construed as indicating any non-claimed element essential to the practice of the present disclosure.

Groupings of alternative elements or embodiments of the present disclosure disclosed herein are not to be construed as limitations. Each group member can be referred to and claimed individually or in any combination with other members of the group or other elements found herein. One or more members of a group can be included in, or deleted from, a group for reasons of convenience or patentability.

Having described the present disclosure in detail, it will be apparent that modifications, variations, and equivalent embodiments are possible without departing the scope of the present disclosure defined in the appended claims. Furthermore, it should be appreciated that all examples in the present disclosure are provided as non-limiting examples.

EXAMPLES

The following examples are included to demonstrate preferred embodiments of the invention. It should be appreciated by those of skill in the art that the techniques disclosed in the examples which follow represent techniques discovered by the inventors to function well in the practice of the invention, and thus can be considered to constitute preferred modes for its practice. However, those of skill in the art should, in light of the present disclosure, appreciate that many changes can be made in the specific embodiments which are disclosed and still obtain a like or similar result without departing from the concept, spirit and scope of the invention. More specifically, it will be apparent that certain agents which are both chemically and physiologically related may be substituted for the agents described herein while the same or similar results would be achieved. All such similar substitutes and modifications apparent to those skilled in the art are deemed to be within the spirit, scope and concept of the invention as defined by the appended claims.

TABLE 1

Synthetic TALER central sequences with varied spacer sizes for sN-TALER and pN-TALER recombination efficiency analysis using reporter construct assay. All sequences are listed in the 5' to 3' orientation.

| SEQ ID NO. | Name of site | TALER central sequence length (bp) | 5' TALE binding site | 5' spacer | Recombinase core sequence | 3' spacer | 3' TALE binding site |
|---|---|---|---|---|---|---|---|
| 1 | GinC6 | | GCAGTGGCGGGAGGCGTGT | | CCAAAACCATGGTTTACA | | GCACGCCTCCCGCCACTGC |
| 2 | Gin18TALE+0 | 18 | AGAAGGTATTTATA | | CCAAAACCATGGTTTACA | | TATAAATACCTTCT |
| 3 | Gin18TALE+1 | 20 | AGAAGGTATTTATA | T | CCAAAACCATGGTTTACA | A | TATAAATACCTTCT |
| 4 | Gin20TALE+0 | 20 | AGAAGGTATTTATA | | TCCAAAACCATGGTTTACAG | | TATAAATACCTTCT |
| 5 | Gin20TALE-T | 20 | AGAAGGTATTTAT | | TCCAAAACCATGGTTTACAG | | ATAAATACCTTCT |
| 6 | Gin20TALE+1 | 22 | AGAAGGTATTTATA | T | TCCAAAACCATGGTTTACAG | A | TATAAATACCTTCT |
| 7 | Gin20TALE+2 | 24 | AGAAGGTATTTATA | TA | TCCAAAACCATGGTTTACAG | TA | TATAAATACCTTCT |
| 8 | Gin20TALE+3 | 26 | AGAAGGTATTTATA | TAA | TCCAAAACCATGGTTTACAG | GTA | TATAAATACCTTCT |
| 9 | Gin20TALE+4 | 28 | AGAAGGTATTTATA | TATA | TCCAAAACCATGGTTTACAG | GCTA | TATAAATACCTTCT |
| 10 | Gin20TALE+5 | 30 | AGAAGGTATTTATA | TATTA | TCCAAAACCATGGTTTACAG | GACTA | TATAAATACCTTCT |
| 11 | Gin20TALE+6 | 32 | AGAAGGTATTTATA | TAGTTA | TCCAAAACCATGGTTTACAG | GACGTA | TATAAATACCTTCT |
| 12 | Gin20TALE+7 | 34 | AGAAGGTATTTATA | TAGGTTA | TCCAAAACCATGGTTTACAG | GACGGTA | TATAAATACCTTCT |
| 13 | Gin20TALE+8 | 36 | AGAAGGTATTTATA | TAGGCTTA | TCCAAAACCATGGTTTACAG | GACCAGTA | TATAAATACCTTCT |
| 14 | Gin20TALE+9 | 38 | AGAAGGTATTTATA | TAGGCATTA | TCCAAAACCATGGTTTACAG | GACACGGTA | TATAAATACCTTCT |
| 15 | Gin20TALE+10 | 40 | AGAAGGTATTTATA | TAGGCACTTA | TCCAAAACCATGGTTTACAG | GACCACGGTA | TATAAATACCTTCT |

TABLE 1-continued

Synthetic TALER central sequences with varied spacer sizes for sN-TALER and pN-TALER recombination efficiency analysis using reporter construct assay. All sequences are listed in the 5' to 3' orientation.

| SEQ ID NO. | Name of site | TALER central sequence length (bp) | 5' TALE binding site | 5' spacer | Recombinase core sequence | 3' spacer | 3' TALE binding site |
|---|---|---|---|---|---|---|---|
| 16 | Gin20TALE+12 | 44 | AGAAGGTATTTATA | TAGGCACACTTA | TCCAAAACCATGGTTTACAG | GACCACACGGTA | TATAAATACCTTCT |
| 17 | Gin20TALE+15 | 50 | AGAAGGTATTTATA | TAGGCACACATGTTA | TCCAAAACCATGGTTTACAG | GACGTTCACACGGTA | TATAAATACCTTCT |

Example 1

TALER Design

Novel recombinases are described herein and referred to as TALERs.

Figure 9:
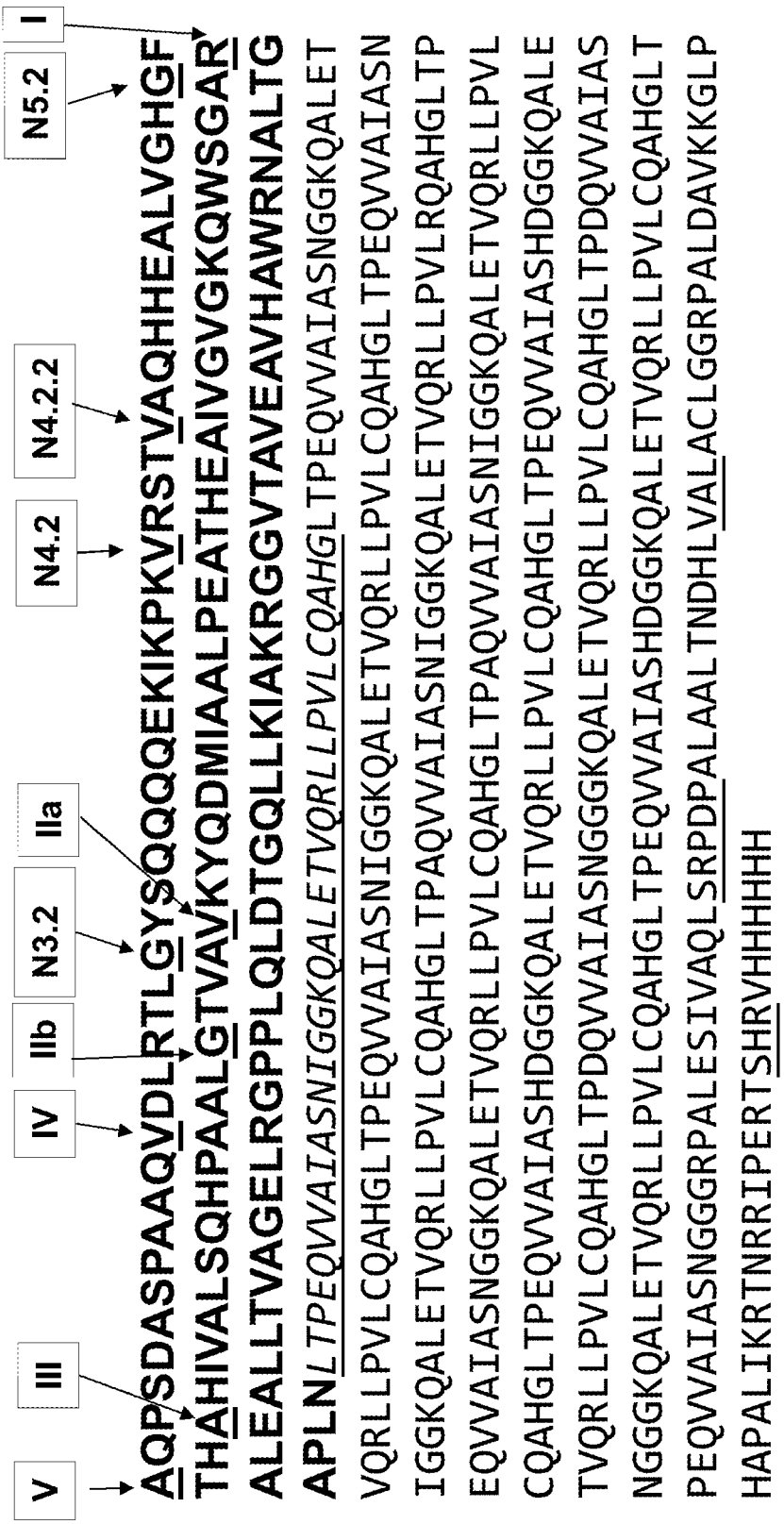
FIG. 9: A schematic representation of the polypeptide sequence of TALE13 protein variants. The location of N-terminal truncations are indicated (sites I, IIa, IIb, III, IV, V, N3.2, N4.2, N4.2.2, and N5.2). For all N-TALERs tested in *E. coli*, the C-terminus was truncated at the SHRV sequence. For all C-TALERs the N-terminus was truncated at position IV (VDLR) and the C-terminal truncations are indicated by underlined sequences SRDP, VAL, and SHR, followed by a 6-His epitope tag. The italicized underlined sequence indicates the first RVD domain. The short underlined sequences indicate N- and C-terminal truncation sites where the optional polypeptide linkers, preceded or followed by a recombinase domain, can be attached.

These TALERs combine a hyperactive recombinase catalytic domain tethered by an optional polypeptide linker of variable length to the N-terminus of a TALE protein (FIG. 1), or by an optional polypeptide linker of variable length to the C-terminus of a TALE protein (FIG. 9). These TALERs are referred to as N-TALERs and C-TALERs, respectively.

Hyperactive recombinases are also referred to as "activated" recombinases and contain one or more mutations that allow the recombinase to function autonomously without recombinase subunits and/or accessory proteins. Such mutations have been described for many individual members, for example, of the small serine recombinase family, and based on sequence homology it is possible to choose mutations in other members of the family that will impart the hyperactive effect (Smith and Thorpe, 2002; Proudfoot et al., 2011).

The GinH106Y recombinase catalytic domain has been demonstrated to be effective as the recombinase catalytic domain in a chimeric zinc finger recombinase (ZFR) (Gordley et al., 2009), and permissive mutant forms have been described (Gersbach et al., 2010; Gordley et al., 2007). The GinH106Y recombinase catalytic domain has a non-permissive requirement for the recombinase core sequence, 5'-TCCAAAACCATGGTTTACAG-3' (SEQ ID NO:18). The Gin recombinase catalytic domain variants, GinL7C7-EE2 and GinL7C7-EE3, have been characterized as having a permissive recombinase catalytic domain (Gersbach et al., 2010). TALER expression constructs were constructed containing one of the Gin recombinase catalytic domains, GinH106Y, GinL7C7-EE2, or GinL7C7-EE3. The novel chimeric TALERs containing the GinH106Y recombinase catalytic domains are herein designated as sN-TALER or sC-TALER (specific) and those containing either GinL7C7-EE2 or GinL7C7-EE3 recombinase catalytic domains are herein designated as pN-TALER or pC-TALER (permissive).

The structure of a TALE DNA-binding domain is that of tandem repeats where each repeat comprises 33 to 35 conserved amino acids with two hypervariable residues (known as repeat-variable di-residues (RVDs)) at positions 12 and 13 (Boch et al., 2009; Moscou and Bodganove, 2009). Each repeat in the TALE protein mediates binding directly to one base pair of the TALE binding site DNA and the RVD of each repeat determines the affinity for the particular base pair. Because repeats containing the various RVDs can be combined in different orders and numbers, TALEs can be designed to bind desired DNA target sites (Boch et al., 2009; Moscou and Bodganove, 2009).

Figure 2:
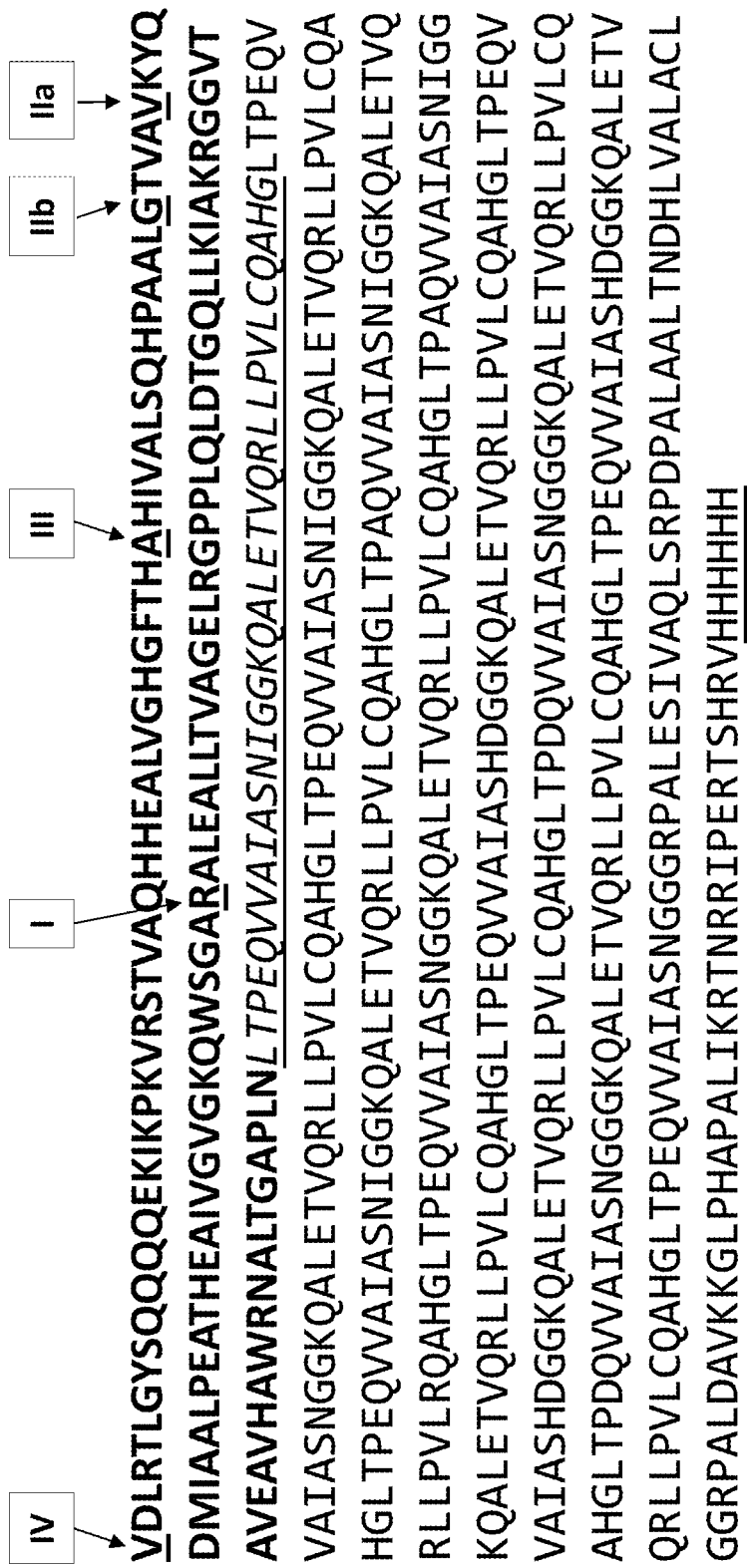
FIG. 2: A schematic representation of the polypeptide sequence of TALE13 protein variants. The location of N-terminal truncations are indicated (sites I, IIa, IIb, III, and IV) as is the 6-His tag epitope tag at the C-terminal truncation. The underlined sequence in italics indicates the first RVD DNA-binding repeat domain.

TALE13 is a modified TALE protein which was cloned from a naturally occurring TALE gene found in *Xanthomonas axonopodis* pathovar *citri* (Miller et al., 2011). To generate N-TALER expression plasmids, five versions of the TALE13 protein were generated, each with varying N-terminal truncations (FIG. 2, sites I, IIa, IIb, III, and IV) and by adding a 6-His tag to the truncated C-terminus (FIG. 2; SEQ ID NOs:19-23). The truncation sites I, IIa, IIb, and III were chosen by analysis of TALE crystal structures (Mak et al., 2012; Deng et al., 2012) and consideration as to the edges of protein motifs. Truncation sites were also selected based on predicted amino acid regions which were specifically not rotated away from amino acid-DNA contact regions. Truncation site IV was chosen based on the report of Miller et al. (2011) that the first 152 amino acids of the full-length TALE13 are dispensable for the DNA-binding function of the TALE 13 protein.

Various N-TALER chimeras were generated by fusion of one of the differing recombinase catalytic domains, an optional amino acid linker, and one of the N-terminal TALE truncation variants (Table 2). The different linkers were selected to be either flexible, somewhat basic or both.

TABLE 2

N-TALER chimeras indicating TALE N-terminal cleavage site, polypeptide linker, recombinase catalytic domain, and corresponding SEQ ID NO.

| TALER variant | TALE N-terminal site | Linker | Recombinase | Nucleotide SEQ ID NO: | Protein SEQ ID NO: |
|---|---|---|---|---|---|
| sN-TALER I-1 | I | no linker | GinH106Y | 24 | 46 |
| sN-TALER I-2 | I | GS | GinH106Y | 25 | 47 |
| sN-TALER I-3 | I | RGSRS | GinH106Y | 26 | 48 |
| sN-TALER IIb-1 | IIb | no linker | GinH106Y | 27 | 49 |

TABLE 2-continued

N-TALER chimeras indicating TALE N-terminal cleavage site,
polypeptide linker, recombinase catalytic domain, and
corresponding SEQ ID NO.

| TALER variant | TALE N-terminal site | Linker | Recombinase | Nucleotide SEQ ID NO: | Protein SEQ ID NO: |
|---|---|---|---|---|---|
| sN-TALER IIa-1 | IIa | RGS | GinH106Y | 28 | 50 |
| sN-TALER IIb-2 | IIb | RGS | GinH106Y | 29 | 51 |
| sN-TALER III-1 | III | GRSGSR | GinH106Y | 30 | 52 |
| sN-TALER III-2 | III | KPKSGESGSPREK | GinH106Y | 31 | 53 |
| sN-TALER IV-1 | IV | TVDRSSDPTSQTS | GinH106Y | 32 | 54 |
| sN-TALER IV-2 | IV | TVDRSSDPTSQTSGSGGSGTS | GinH106Y | 33 | 55 |
| sN-TALER IV-3 | IV | DRSSDPTSQTS | GinH106Y | 34 | 56 |
| sN-TALER IV-3.2 | IV | DRSSDPTSQT | GinH106Y | 35 | 57 |
| sN-TALER IV-4 | IV | DRSSDPTS | GinH106Y | 36 | 58 |
| sN-TALER IV-5 | IV | SSDPTS | GinH106Y | 37 | 59 |
| sN-TALER IV-6 | IV | SSDP | GinH106Y | 38 | 60 |
| pN-TALER IV-1-EE2 | IV | TVDRSSDPTSQTS | GinL7C7-EE2 | 41 | 63 |
| pN-TALER IV-5-EE2 | IV | SSDPTS | GinL7C7-EE2 | 42 | 64 |
| pN-TALER IV-6-EE2 | IV | SSDP | GinL7C7-EE2 | 43 | 65 |
| pN-TALER IV-8-EE2 | IV | no linker | GinL7C7-EE2 | 44 | 66 |
| pN-TALER IV-1-EE3 | IV | TVDRSSDPTSQTS | GinL7C7-EE3 | 45 | 67 |

Figure 3:
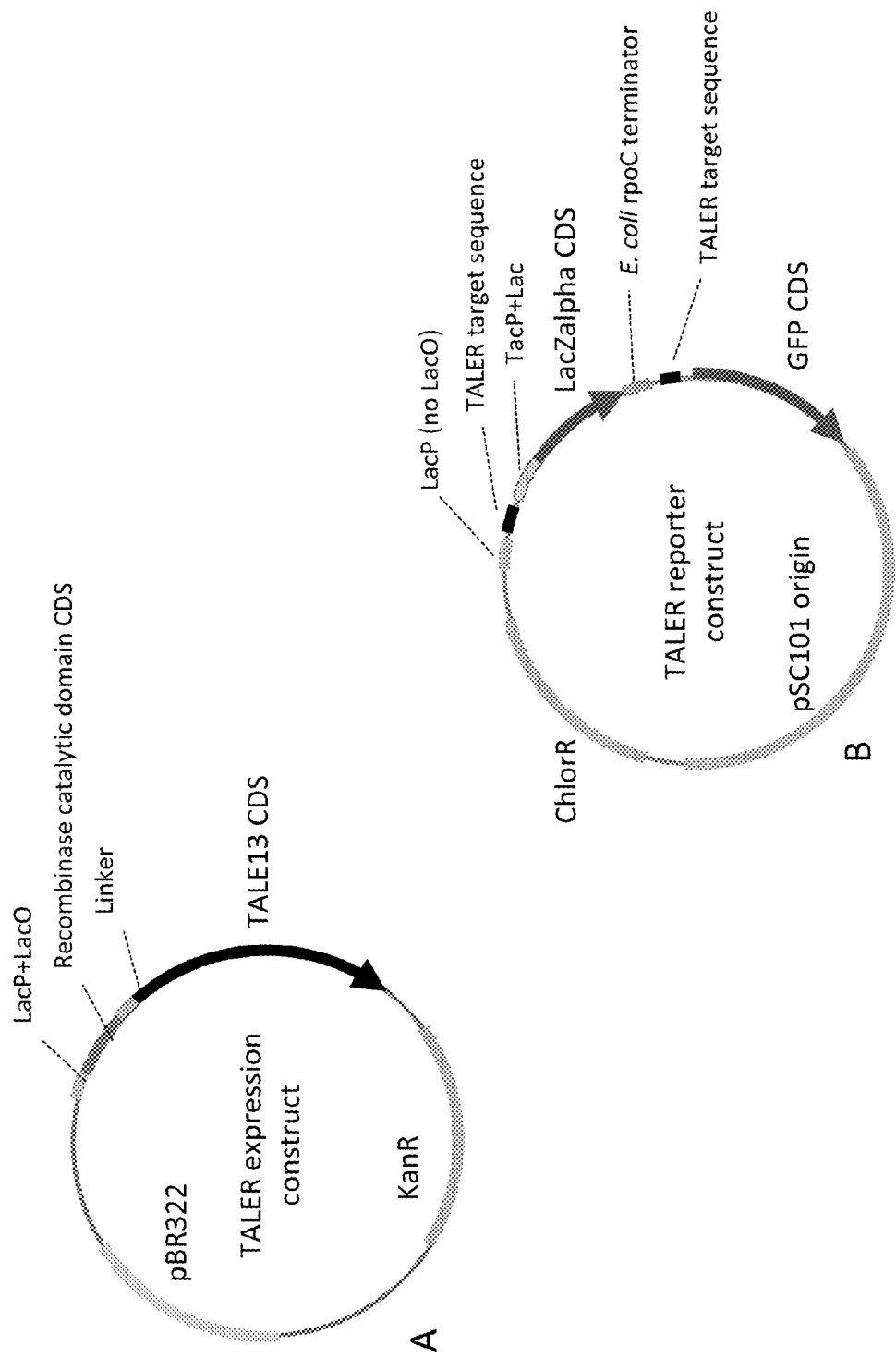
FIG. 3: A schematic representation of (A) an N-TALER expression construct and (B) an N-TALER reporter construct.

For expression of the chimeric TALER protein, the corresponding coding sequence was cloned into and expressed from the LacP with LacO and RBS from pUC19. The plasmid backbone is pET28b, which has kanamycin resistance (KanR) (FIG. 3A). These TALER expression plasmids were synthesized by GENSCRIPT (Piscataway, N.J.) or made at Monsanto.

C-TALER Design

Previous attempts to make TALE-recombinase fusions where a small serine recombinase catalytic domain was attached to the C-terminus of a TALE protein (C-TALER) were reported to be unsuccessful, whereas N-terminal recombinases (N-TALER) were reported to be functional (Mercer et al., 2012).

To generate C-TALER expression plasmids, the same TALE13 gene used for N-TALER chimera construction was used to generate C-TALER chimeras. The N-terminus of the TALE gene was truncated at position IV (FIG. 9). C-TALERs with differing truncations at the TALE N-terminus are also contemplated, and these are expected to function as the N-TALERs did in the following experiments. Three locations were chosen in the C-terminus of TALE13 to attach the recombinase catalytic domain: SHR, VAL, and SRPDP (the C-terminal regions are illustrated by SEQ ID NOs:84, 85, 86, respectively; FIG. 9, underlined sequence). The N-terminus of the recombinase catalytic domain was tethered by one of two linkers (Linker A1, SEQ ID NO:77 or Linker A2, SEQ ID NO:78) to the different C-terminal positions of the TALE DNA-binding domain (Table 3). A His-tag was designed on the C-terminus of each C-TALER expression construct.

In the wild-type small serine recombinase, the catalytic domain may be held in place on the DNA target sequence through a C-terminal extension ending with a putative DNA-contact domain. Based on this native structure, the C-TALER chimeras comprising one of four different additional DNA-contact domains, or no additional DNA-contact domain, were designed and tested (Table 3). The specific DNA-contact domains which have been tested include i) the C-terminus from the native Gin recombinase (SEQ ID NO:80); ii) a monomeric *Leishmania* histone (mlh) (SEQ ID NO:81); iii) a DNA-binding domain from the ruvA Holliday junction resolvase (SEQ ID NO:82); and iv) a short peptide designed to comprise several basic residues (SEQ ID NO:83).

Figure 10:
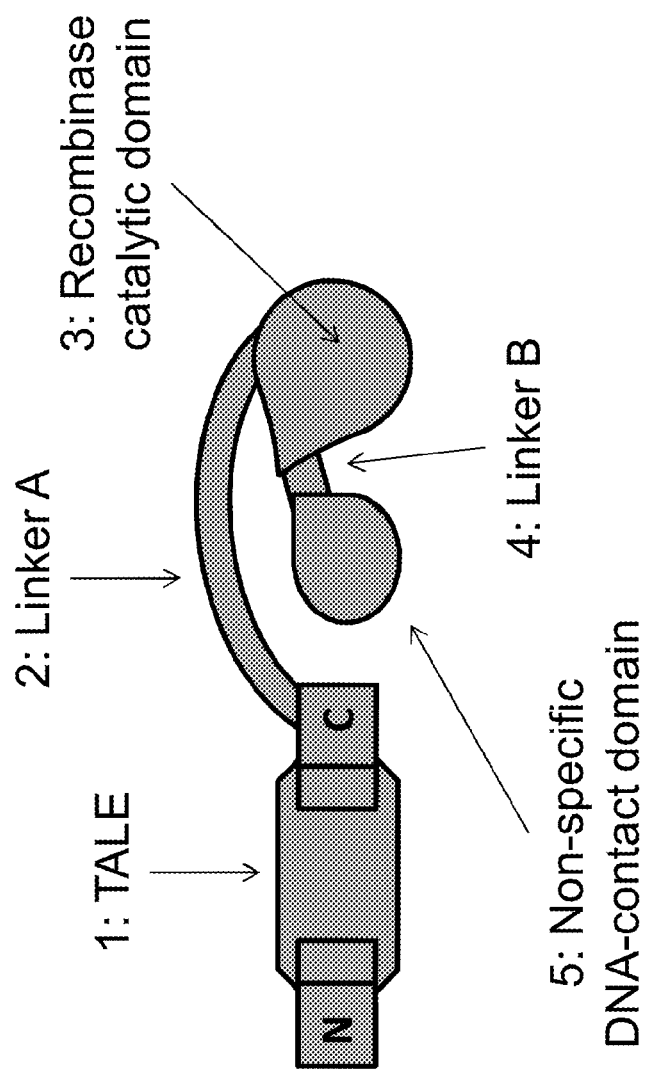
FIG. 10: A schematic of C-TALER structure.
Figure 10:
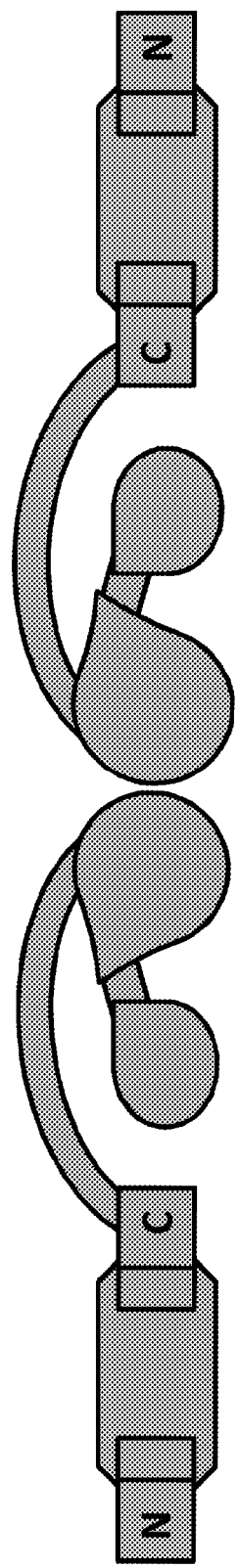

The C-TALER expression construct containing the ruvA DNA-contact domain was tethered to the C-terminus of the serine recombinase catalytic domain by a linker (linker B; SEQ ID NO:79; Table 3; FIG. 10). The C-TALER constructs without a DNA-contact domain were generated by removing the ruvA DNA-contact domain while retaining linker B. For the other three C-TALER expression constructs, the DNA-contact domain was tethered directly to the C-terminus of the serine recombinase catalytic domain (i.e., no linker B). The three C-terminal truncations of the TALE DNA-binding domain are represented by SEQ ID NOs:84-86.

TABLE 3

C-TALER expression constructs.

| Construct designation | TALE C-terminus truncation | Linker A version | Recombinase catalytic domain | Linker B (SEQ ID NO: 79) | DNA-contact domain | SEQ ID NO: |
|---|---|---|---|---|---|---|
| Gin | | | | | | |
| G3-1 | SHR | 1 | GinH106Y | none | Gin C-terminus | 87 |
| G2-1 | VAL | 1 | GinH106Y | none | Gin C-terminus | 88 |
| G1-1 | SRPDP | 1 | GinH106Y | none | Gin C-terminus | 89 |
| G3-2 | SHR | 2 | GinH106Y | none | Gin C-terminus | 90 |
| G2-2 | VAL | 2 | GinH106Y | none | Gin C-terminus | 91 |
| G1-2 | SRPDP | 2 | GinH106Y | none | Gin C-terminus | 92 |
| mlh | | | | | | |
| A3-1 | SHR | 1 | GinH106Y | none | mlh | 93 |
| B3-1 | VAL | 1 | GinH106Y | none | mlh | 94 |
| C3-1 | SRPDP | 1 | GinH106Y | none | mlh | 95 |
| A3-2 | SHR | 2 | GinH106Y | none | mlh | 96 |
| B3-2 | VAL | 2 | GinH106Y | none | mlh | 97 |
| C3-2 | SRPDP | 2 | GinH106Y | none | mlh | 98 |
| ruvA | | | | | | |
| A2-1 | SHR | 1 | GinH106Y | GGSGKEGS | ruvA | 99 |
| B2-1 | VAL | 1 | GinH106Y | GGSGKEGS | ruvA | 100 |
| C2-1 | SRPDP | 1 | GinH106Y | GGSGKEGS | ruvA | 101 |
| A2-2 | SHR | 2 | GinH106Y | GGSGKEGS | ruvA | 102 |
| B2-2 | VAL | 2 | GinH106Y | GGSGKEGS | ruvA | 103 |
| C2-2 | SRPDP | 2 | GinH106Y | GGSGKEGS | ruvA | 104 |
| pA2-1 | SHR | 1 | GinL7C7-EE2 | GGSGKEGS | ruvA | 105 |
| pB2-1 | VAL | 1 | GinL7C7-EE2 | GGSGKEGS | ruvA | 106 |
| pC2-1 | SRPDP | 1 | GinL7C7-EE2 | GGSGKEGS | ruvA | 107 |
| pA2-2 | SHR | 2 | GinL7C7-EE2 | GGSGKEGS | ruvA | 108 |
| pB2-2 | VAL | 2 | GinL7C7-EE2 | GGSGKEGS | ruvA | 109 |
| pC2-2 | SRPDP | 2 | GinL7C7-EE2 | GGSGKEGS | ruvA | 110 |
| basic peptide | | | | | | |
| A1-1 | SHR | 1 | GinH106Y | none | kkssrakkpakk | 111 |
| B1-1 | VAL | 1 | GinH106Y | none | kkssrakkpakk | 112 |
| C1-1 | SRPDP | 1 | GinH106Y | none | kkssrakkpakk | 113 |
| A1-2 | SHR | 2 | GinH106Y | none | kkssrakkpakk | 114 |

TABLE 3-continued

C-TALER expression constructs.

| Construct designation | TALE C-terminus truncation | Linker A version | Recombinase catalytic domain | Linker B (SEQ ID NO: 79) | DNA-contact domain | SEQ ID NO: |
|---|---|---|---|---|---|---|
| B1-2 | VAL | 2 | GinH106Y | none | kkssrakkpakk | 115 |
| C1-2 | SRPDP | 2 | GinH106Y | none | kkssrakkpakk | 116 |
| none A4-1 | SHR | 1 | GinH106Y | GGSGKEGS | none | 117 |
| B4-1 | VAL | 1 | GinH106Y | GGSGKEGS | none | 118 |
| C4-1 | SRPDP | 1 | GinH106Y | GGSGKEGS | none | 119 |
| A4-2 | SHR | 2 | GinH106Y | GGSGKEGS | none | 120 |
| B4-2 | VAL | 2 | GinH106Y | GGSGKEGS | none | 121 |
| C4-2 | SRPDP | 2 | GinH106Y | GGSGKEGS | none | 122 |
| pA4-1 | SHR | 1 | GinL7C7-EE2 | GGSGKEGS | none | 123 |
| pA4-2 | SHR | 2 | GinL7C7-EE2 | GGSGKEGS | none | 124 |

Linker A1 (SEQ ID NO: 77),
Linker A2 (SEQ ID NO: 78).

Example 2

Generation of N-TALER Reporter Constructs

To test the chimeric N-TALERs for recombination activity, a series of reporter constructs were made that contain different recombination sites. The N-TALER reporter constructs and N-TALER expression constructs were co-transformed into bacteria. The design of the N-TALER reporter construct was such that a visual blue/white color screening of the bacterial transformants would determine whether recombination occurred. The synthetic TALER target sequences flank a LacZalpha (LacZa) coding sequence (CDS) expressed from the TacP with the LacO (FIG. 3B). Upon recombination, the LacZa cassette is removed and the resulting colonies will be white when the bacteria are plated on X-Gal containing media. Incorporated into the reporter plasmid was an additional reporter gene, a green fluorescent protein (GFP), down stream of the LacZa cassette (FIG. 3B). The LacZa cassette, flanked by the synthetic TALER target sequences, is positioned between a LacP and the GFP CDS so that upon removal of the LacZa cassette, the GFP CDS should be expressed. The reporter construct plasmids were synthesized and incorporated the low copy origin of replication from pSC101 and a CAT gene to give chloramphenicol resistance (FIG. 3B).

Figure 4:
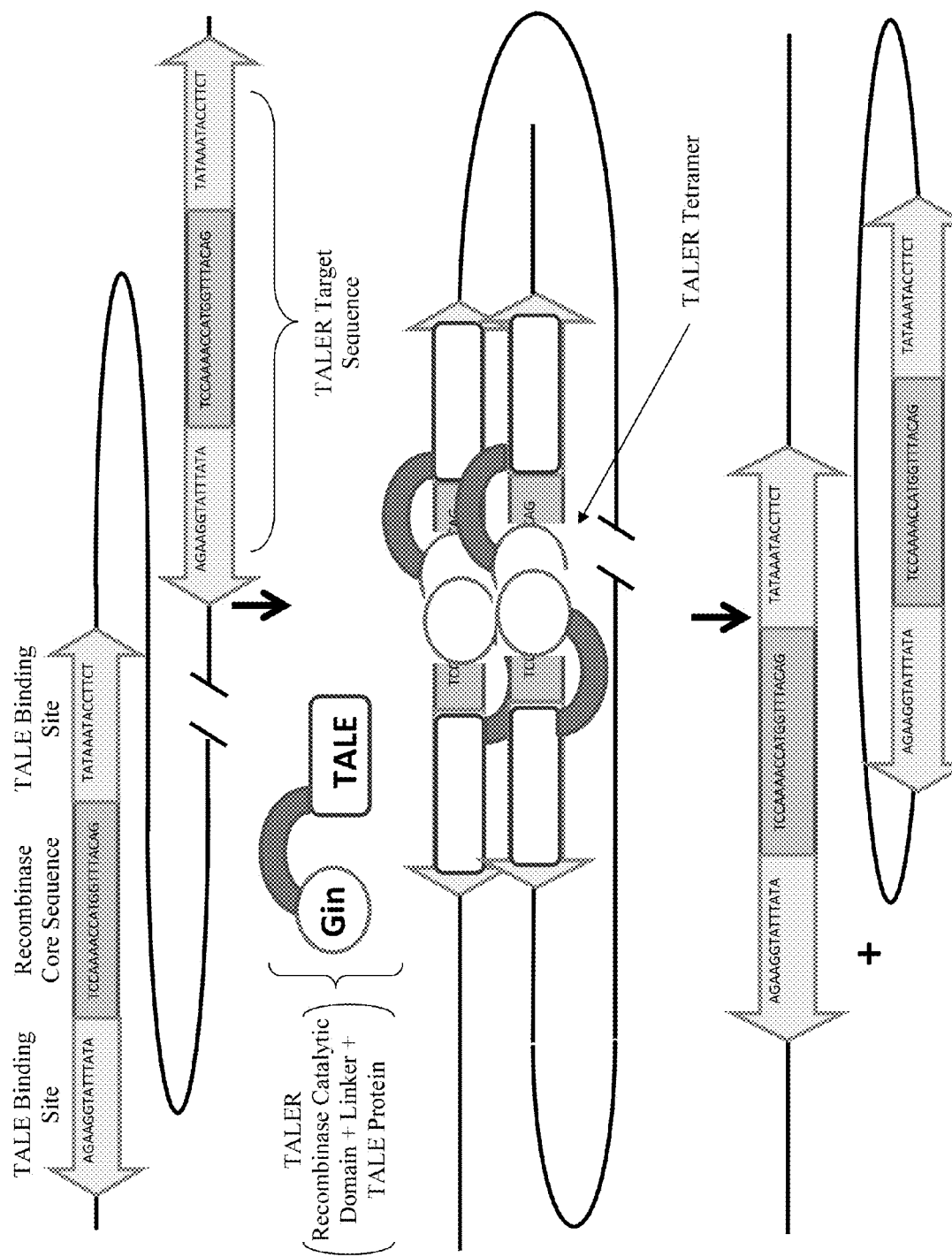
FIG. 4: A schematic representation of N-TALER-mediated recombination.

The synthetic TALER target sequences in the reporter constructs consisted of a recombinase core sequence flanked by TALE binding sites oriented so that the N-terminus of the TALE protein, when binding to the DNA, will be adjacent to the recombinase core sequence for the Gin recombinase catalytic domain with or without a 5'- and 3'-spacer (Table 1 and FIG. 4). TALE proteins have a preference in their respective DNA-binding sites for a 5'-T. However, not all endogenous TALE binding sites contain a 5'-T. Individual TALE proteins have a preferred binding site sequence determined by the sequence of DNA-binding repeats of the RVDs. Depending on the unique set of DNA-binding repeats, the same TALE protein will bind to multiple variants of the preferred TALE binding site, though with differing affinity. The native binding site sequence for TALE13 is 5'-(T)ATAAATACCTTCT-3' (SEQ ID NOs:75 and 76; Miller et al., 2011). The T in parenthesis indicates that this nucleotide is not encoded by a specific DNA-binding repeat but is instead determined by the inherent preference that TALE DNA-binding domains have for a 5'-T.

The Gin recombinase catalytic domain from GinH106Y has been shown to recombine the by recombinase core sequence 5'-TCCAAAACCATGGTTTACAG-3' (SEQ ID NO:18) in the context of a zinc finger recombinase (Gordley 2007, 2009). It is known that many of the nucleotides in this sequence are not required for efficient recombination (Hughes et al., 1992; Rimphanitchayakit and Grindley, 1990). For the purposes of these experiments, the TALER target sequence of the reporter constructs includes the sequence between the two flanking TALE binding sites; namely, the recombinase core sequence and each of the 5' and 3' spacers (Table 1 for N-TALER central sequences and Table 5 for C-TALER central sequences). The different TALER reporter constructs vary from one another by: i) the spacer sequences between the recombination core sequence and the adjacent, flanking TALE binding sites; ii) the sequence of the recombinase core sequence; and iii) the TALE binding site DNA sequences as described below and detailed in Tables 1, 4, and 5.

The synthetic TALER target sequences listed in Table 1 were designed to test the recombination ability of sN-TALERs and pN-TALERs. The synthetic TALER target sequences listed in Table 4 were designed with truncations of the Gin recombinase core sequences to test both sN-TALERs and pN-TALERs using varying polypeptide linker lengths.

In each of the TALER reporter constructs generated for these experiments, the recombinase core sequence is flanked by TALE binding sites in an inverted orientation relative to each other so that the site forms a pseudo palindrome. Consequently, only a single TALER expression construct is required for recombination to occur following co-transformation with a reporter construct. Tetramers of hyperactive recombinases are required to mediate DNA recombination (FIG. 4). Therefore, although this assay requires only a single TALER expression construct for efficient recombination of the reporter construct, gene-targeting may require 1, 2, 3, or 4, or up to 8 unique TALERs.

TABLE 4

Synthetic TALER central sequences with varied recombinase core sequence length for sN-TALER and pN-TALER recombination efficiency analysis using reporter construct assay. All sequences are listed in the 5' to 3' orientation.

| SEQ ID NO: | Name of site | Central sequence length (bp) | 5' TALE Binding Site | 5' spacer | Recombinase core sequence | 3' spacer | 3' TALE Binding Site |
|---|---|---|---|---|---|---|---|
| 68 | Gin16TALE | 16 | AGAAGGTATTTATA | | CAAAACCATGGTTTAC | | TATAAATACCTTCT |
| 68 | Gin14TALE | 14 | AGAAGGTATTTATA | | AAAACCATGGTTTA | | TATAAATACCTTCT |
| 70 | Gin12TALE | 12 | AGAAGGTATTTATA | | AAACCATGGTTT | | TATAAATACCTTCT |
| 71 | Gin10TALE | 10 | AGAAGGTATTTATA | | AACCATGGTT | | TATAAATACCTTCT |
| 72 | Gin8TALE | 8 | AGAAGGTATTTATA | | ACCATGGT | | TATAAATACCTTCT |
| 73 | Gin6TALE | 6 | AGAAGGTATTTATA | | CCATGG | | TATAAATACCTTCT |
| 74 | Gin4TALE | 4 | AGAAGGTATTTATA | | CATG | | TATAAATACCTTCT |

Generation of C-TALER Reporter Constructs

Figure 11:
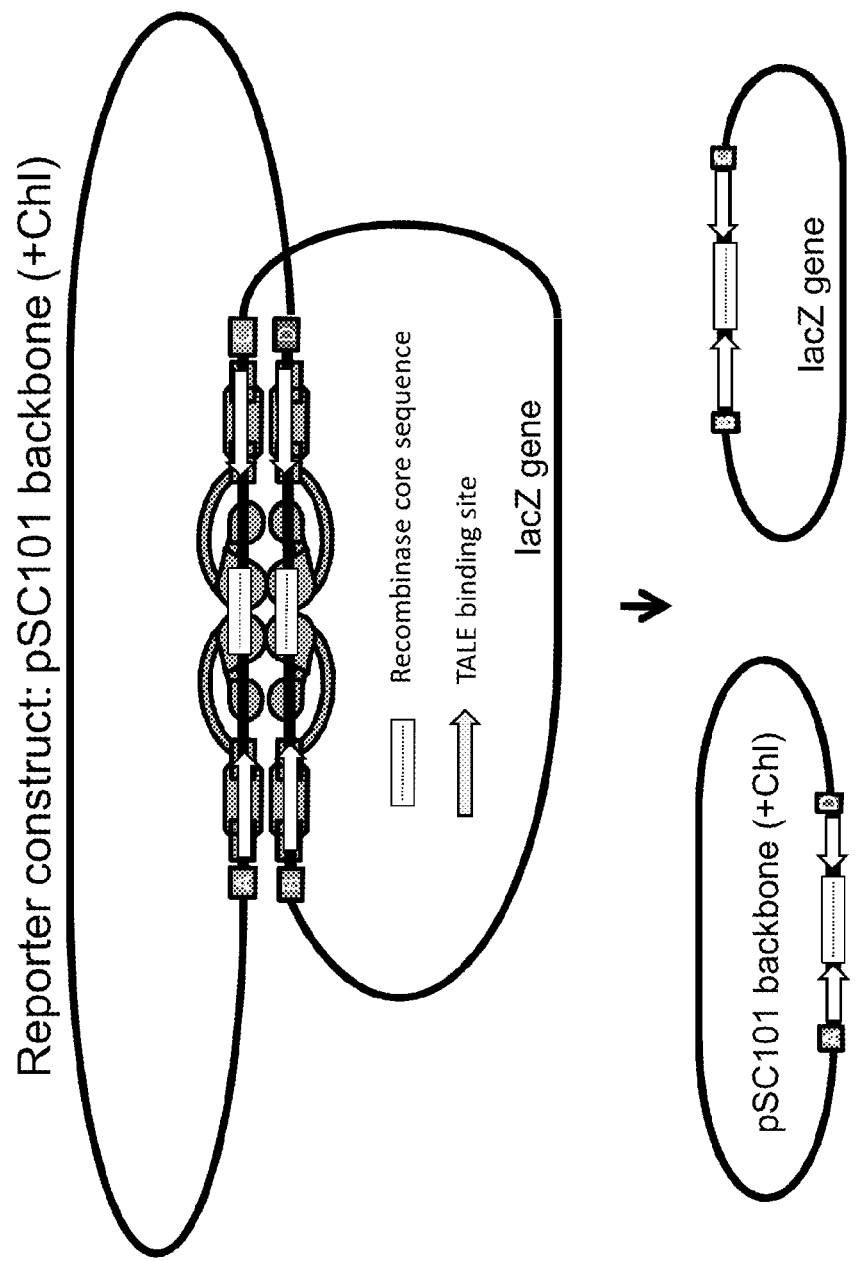
FIG. 11: A schematic representation of C-TALER-mediated recombination.

To test C-TALER chimeric polypeptides for efficient target site recombination, a series of C-TALER reporter constructs were designed. Because the recombinase catalytic domain in the C-TALER is on the C-terminus of the TALE DNA-binding domain, in the C-TALER reporter constructs the TALE DNA-binding sites flanking the recombinase target site was inverted 5' to 3' relative to the orientation of the TALE DNA-binding sequence in the N-TALER reporter constructs (FIG. 11, Table 5). The C-TALER reporter expression constructs contain two TALER recombination sites of the following general sequence and with varying spacer length (NNN). This is illustrated below:

| 5' Inverted TALE13 binding site | TALER central sequence | | | 3' Inverted TALE13 binding site |
|---|---|---|---|---|
| | 5' Spacer | Recombinase core sequence | 3' Spacer | |
| TATAAATACCTTCT | NNN | CCAAAACCATGGTTTACA | NNN | AGAAGGTATTTATA |

TABLE 5

Synthetic TALER sequences with varied spacer sizes for C-TALER recombination efficiency analysis using reporter construct assay. All sequences are listed in the 5' to 3' orientation. Reporter construct R71 was used as a negative control and had both TALE binding sites in the reverse orientation from C-TALER reporter constructs R60 to R70.

| SEQ ID NO. | Name of site | Construct label | 5' Inverted TALE binding site | 5' spacer | Recombinase core sequence | 3' spacer | 3' Inverted TALE binding site |
|---|---|---|---|---|---|---|---|
| 125 | Gin18+Inverted TALE13 | R60 | TATAAATACCTTCT | | CCAAAACCATGGTTTACA | | AGAAGGTATTTATA |
| 126 | Gin20+inverted TALE13 | R61 | TATAAATACCTTCT | | TCCAAAACCATGGTTTACAG | | AGAAGGTATTTATA |
| 127 | Gin20+Inverted TALE13+1 | R62 | TATAAATACCTTCT | A | TCCAAAACCATGGTTTACAG | G | AGAAGGTATTTATA |
| 128 | Gin20+Inverted TALE13+2 | R63 | TATAAATACCTTCT | TA | TCCAAAACCATGGTTTACAG | GA | AGAAGGTATTTATA |
| 129 | Gin20+Inverted TALE13+4 | R64 | TATAAATACCTTCT | TTTA | TCCAAAACCATGGTTTACAG | GAAA | AGAAGGTATTTATA |
| 130 | Gin20+Inverted TALE13+6 | R65 | TATAAATACCTTCT | CGTTTA | TCCAAAACCATGGTTTACAG | GAAACG | AGAAGGTATTTATA |
| 131 | Gin20+Inverted TALE13+8 | R66 | TATAAATACCTTCT | TCCGTTTA | TCCAAAACCATGGTTTACAG | GAAACGGT | AGAAGGTATTTATA |
| 132 | Gin20+Inverted TALE13+10 | R67 | TATAAATACCTTCT | CGTCCGTTTA | TCCAAAACCATGGTTTACAG | GAAACGGTCG | AGAAGGTATTTATA |

TABLE 5-continued

Synthetic TALER sequences with varied spacer sizes for C-TALER recombination efficiency analysis using reporter construct assay. All sequences are listed in the 5' to 3' orientation. Reporter construct R71 was used as a negative control and had both TALE binding sites in the reverse orientation from C-TALER reporter constructs R60 to R70.

| SEQ ID NO. | Name of site | Construct label | 5' Inverted TALE binding site | TALER central sequence 5' spacer | Recombinase core sequence | 3' spacer | 3' Inverted TALE binding site |
|---|---|---|---|---|---|---|---|
| 133 | Gin20+Inverted TALE13+12 | R68 | TATAAATACCTTCT | ACCGTCCGTTTA | TCCAAAACCATGGTTTACAG | GAAACGGTCGAC | AGAAGGTATTTATA |
| 134 | Gin20+Inverted TALE13+15 | R69 | TATAAATACCTTCT | GCTACCGTCCGTTTA | TCCAAAACCATGGTTTACAG | GAAACGGTCGACGCT | AGAAGGTATTTATA |
| 135 | Gin20+Inverted TALE13+20 | R70 | TATAAATACCTTCT | AGCCAGCTACCGTCCGTTTA | TCCAAAACCATGGTTTACAG | GAAACGGTCGACGCTAGCCA | AGAAGGTATTTATA |
| 136 | Gin20+TALE13+20 | R71 | AGAAGGTATTTATA | AGCCAGCTACCGTCCGTTTA | TCCAAAACCATGGTTTACAG | GAAACGGTCGACGCTAGCCA | TATAAATACCTTCT |

Example 3

N-TALER Experimental Assay Protocol

To test for recombination, *E. coli* DH5alpha cells were co-transformed with different combinations of TALER expression construct and TALER reporter construct pairs (Tables 6 and 7). The N-TALER expression and reporter constructs were in an approximate 1:1 mass ratio during the transformation. The co-transformed bacteria were plated on media with chloramphenicol, kanamycin, and X-gal then incubated at 37° C. for 18 to 36 hours. Control samples consisted of transformations using the reporter construct alone. Control transformants were similarly plated. The bacterial transformation protocol was either heat shock or electroporation per standard molecular biology techniques.

Figure 5:
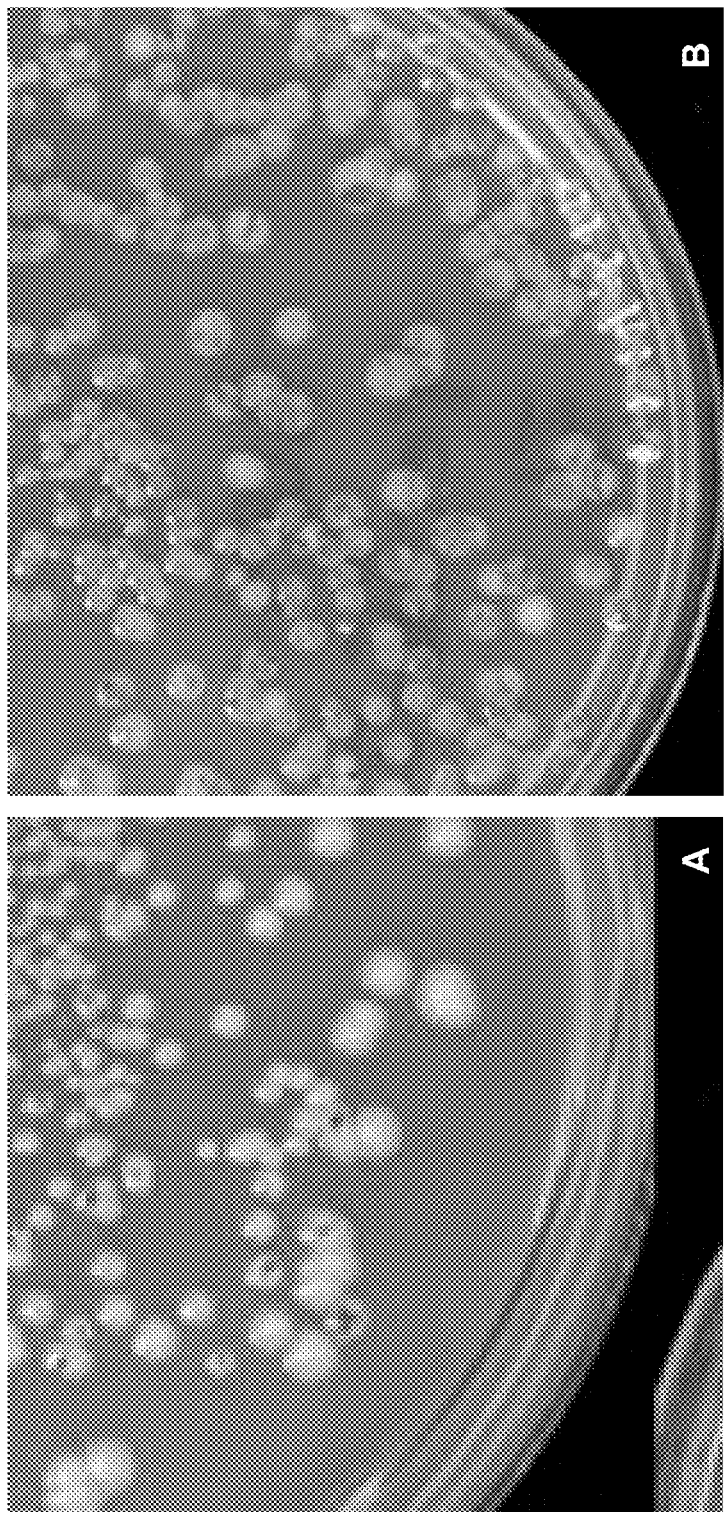
FIG. 5: N-TALER expression in *E. coli* colonies expressing N-TALER reporter constructs plated on X-gal plates produced white or sectored colonies. Colonies were visually scored based on a range of: no recombination (blue colonies), mixed efficiency of recombination (sectored colonies), and complete, efficient recombination (white colonies).

As expected, the control transformations (no N-TALER expression plasmid) showed no recombination of the N-TALER reporter construct, as evidenced by blue colonies. Numerous sN-TALERs tested with two or more reporter constructs also failed to show recombination. Other N-TALER expression and N-TALER reporter construct combinations gave white or sectored colonies (FIG. 5). A scoring system was established to indicate the range of recombination which varied from no recombination (blue colonies), mixed levels of recombination (sectored colonies), and complete recombination (white colonies). The description of the visual criteria for assigning a score is as follows:

1=All, or almost all, of the colonies are white. A few blue colonies may be present.
2=Over a third of the colonies are white and the rest are sectored (possibly with a few blue colonies). The sectored colonies have very small blue sectors.
3=All, or almost all of the colonies are sectored. The size and intensity of the blue color may vary among plates with this score. In some cases, it appears that the colonies are more blue than white while in other plates the colonies are more white than blue. Because of variation in X-gal concentration and growing conditions, this category is usually not subdivided.
4=Over a third of the colonies are pure blue, but there are many sectored colonies and most sectored colonies have large blue sectors with small white sectors.
5=All, or almost all, of the colonies are blue. A very small number of white or sectored colonies may be present.

Scores of 1.5 indicate plates where the majority of the colonies are white but with some having very small blue sectors. However, if a plate has colonies that are all sectored, but the blue sectors are very small, a score of 2.5 may be assigned. Conversely, plates with colonies that are all sectored but the blue sectors are large may be assigned a score of 3.5. A score of 4.5 indicates that almost all of the colonies are entirely blue but some with small white sectors are present. These scores differ from a score of 1, 2, 3, or 4 respectively by the frequency and size of colonies with small sectors. It should be noted that actually percentages were not determined and as such the difference between, for example, a 1 and 1.5, or a 1.5 and a 2, may be subjective. Typically fine distinctions between scores such as, for example, 1.5 versus 2 were given when several plates were produced in a single experiment and when held side by side there appeared to be a difference between them for the number and/or size of the sectors.

TABLE 6

Scoring of bacterial transformants assayed for sN-TALER-mediated recombination of N-TALER reporter constructs.

| N-TALER variant | Linker | Reporter | TALER central sequence length (bp) | Score |
|---|---|---|---|---|
| No TALER | n/a | Gin18TALE+0 | 18 | 5 |
| No TALER | n/a | Gin18TALE+1 | 20 | 5 |
| No TALER | n/a | Gin20TALE-T | 20 | 5 |

TABLE 6-continued

Scoring of bacterial transformants assayed for sN-TALER-mediated recombination of N-TALER reporter constructs.

| N-TALER variant | Linker | Reporter | TALER central sequence length (bp) | Score |
|---|---|---|---|---|
| No TALER | n/a | Gin20TALE+0 | 20 | 5 |
| No TALER | n/a | Gin20TALE+1 | 22 | 5 |
| No TALER | n/a | Gin20TALE+2 | 24 | 5 |
| No TALER | n/a | Gin20TALE+3 | 26 | 5 |
| No TALER | n/a | Gin20TALE+4 | 28 | 5 |
| No TALER | n/a | Gin20TALE+5 | 30 | 5 |
| No TALER | n/a | Gin20TALE+6 | 32 | 5 |
| No TALER | n/a | Gin20TALE+7 | 34 | 5 |
| No TALER | n/a | Gin20TALE+8 | 36 | 5 |
| No TALER | n/a | Gin20TALE+9 | 38 | 5 |
| No TALER | n/a | Gin20TALE+10 | 40 | 5 |
| No TALER | n/a | Gin20TALE+12 | 44 | 5 |
| No TALER | n/a | Gin20TALE+15 | 50 | 5 |
| sN-TALER I-1 | no linker | Gin18TALE+0 | 18 | 4.5 |
| sN-TALER I-1 | no linker | Gin18TALE+1 | 20 | 5 |
| sN-TALER I-1 | no linker | Gin20TALE+0 | 20 | 5 |
| sN-TALER I-2 | GS | Gin18TALE+0 | 18 | 4 |
| sN-TALER I-2 | GS | Gin20TALE+0 | 20 | 5 |
| sN-TALER I-3 | RGSRS | Gin18TALE+0 | 18 | 5 |
| sN-TALER I-3 | RGSRS | Gin18TALE+1 | 20 | 5 |
| sN-TALER I-3 | RGSRS | Gin20TALE+0 | 20 | 5 |
| sN-TALER IIb-1 | no linker | Gin18TALE+0 | 18 | 3 |
| sN-TALER IIb-1 | no linker | Gin20TALE+0 | 20 | 5 |
| sN-TALER IIb-1 | no linker | Gin20TALE+3 | 26 | 5 |
| sN-TALER IIb-1 | no linker | Gin20TALE+10 | 40 | 5 |
| sN-TALER IIa-1 | RGS | Gin18TALE+0 | 18 | 4 |
| sN-TALER IIa-1 | RGS | Gin20TALE+0 | 20 | 5 |
| sN-TALER IIa-1 | RGS | Gin20TALE+10 | 40 | 5 |
| sN-TALER IIb-2 | RGS | Gin18TALE+0 | 18 | 4 |
| sN-TALER IIb-2 | RGS | Gin20TALE+0 | 20 | 5 |
| sN-TALER IIb-2 | RGS | Gin20TALE+10 | 40 | 5 |
| sN-TALER III-1 | GRSGSR | Gin18TALE+0 | 18 | 4.5 |
| sN-TALER III-1 | GRSGSR | Gin20TALE+0 | 20 | 5 |
| sN-TALER III-1 | GRSGSR | Gin20TALE+10 | 40 | 5 |
| sN-TALER III-2 | KPKSGESGSPREK | Gin18TALE+0 | 18 | 5 |
| sN-TALER III-2 | KPKSGESGSPREK | Gin18TALE+1 | 20 | 5 |

TABLE 6-continued

Scoring of bacterial transformants assayed for sN-TALER-mediated recombination of N-TALER reporter constructs.

| N-TALER variant | Linker | Reporter | TALER central sequence length (bp) | Score |
| --- | --- | --- | --- | --- |
| sN-TALER III-2 | KPKSGESGSPREK | Gin20TALE+0 | 20 | 5 |
| sN-TALER III-2 | KPKSGESGSPREK | Gin20TALE+10 | 40 | 5 |
| sN-TALER IV-1 | TVDRSSDPTSQTS | Gin18TALE+0 | 18 | 1 |
| sN-TALER IV-1 | TVDRSSDPTSQTS | Gin18TALE+1 | 20 | 1 |
| sN-TALER IV-1 | TVDRSSDPTSQTS | Gin20TALE-T | 20 | 3 |
| sN-TALER IV-1 | TVDRSSDPTSQTS | Gin20TALE+0 | 20 | 1 |
| sN-TALER IV-1 | TVDRSSDPTSQTS | Gin20TALE+1 | 22 | 2 |
| sN-TALER IV-1 | TVDRSSDPTSQTS | Gin20TALE+2 | 24 | 3 |
| sN-TALER IV-1 | TVDRSSDPTSQTS | Gin20TALE+3 | 26 | 3 |
| sN-TALER IV-1 | TVDRSSDPTSQTS | Gin20TALE+4 | 28 | 5 |
| sN-TALER IV-1 | TVDRSSDPTSQTS | Gin20TALE+5 | 30 | 5 |
| sN-TALER IV-1 | TVDRSSDPTSQTS | Gin20TALE+6 | 32 | 5 |
| sN-TALER IV-1 | TVDRSSDPTSQTS | Gin20TALE+7 | 34 | 5 |
| sN-TALER IV-1 | TVDRSSDPTSQTS | Gin20TALE+8 | 36 | 5 |
| sN-TALER IV-1 | TVDRSSDPTSQTS | Gin20TALE+9 | 38 | 2 |
| sN-TALER IV-1 | TVDRSSDPTSQTS | Gin20TALE+10 | 40 | 1.5 |
| sN-TALER IV-1 | TVDRSSDPTSQTS | Gin20TALE+12 | 44 | 2 |
| sN-TALER IV-1 | TVDRSSDPTSQTS | Gin20TALE+15 | 50 | 5 |
| sN-TALER IV-2 | TVDRSSDPTSQTSGSGGSGTS | Gin18TALE+0 | 18 | 1 |
| sN-TALER IV-2 | TVDRSSDPTSQTSGSGGSGTS | Gin18TALE+1 | 20 | 2 |
| sN-TALER IV-2 | TVDRSSDPTSQTSGSGGSGTS | Gin20TALE-T | 20 | 3 |
| sN-TALER IV-2 | TVDRSSDPTSQTSGSGGSGTS | Gin20TALE+0 | 20 | 1 |
| sN-TALER IV-2 | TVDRSSDPTSQTSGSGGSGTS | Gin20TALE+1 | 22 | 1 |
| sN-TALER IV-2 | TVDRSSDPTSQTSGSGGSGTS | Gin20TALE+2 | 24 | 3 |
| sN-TALER IV-2 | TVDRSSDPTSQTSGSGGSGTS | Gin20TALE+3 | 26 | 3 |
| sN-TALER IV-2 | TVDRSSDPTSQTSGSGGSGTS | Gin20TALE+4 | 28 | 4 |
| sN-TALER IV-2 | TVDRSSDPTSQTSGSGGSGTS | Gin20TALE+5 | 30 | 5 |
| sN-TALER IV-2 | TVDRSSDPTSQTSGSGGSGTS | Gin20TALE+6 | 32 | 5 |
| sN-TALER IV-2 | TVDRSSDPTSQTSGSGGSGTS | Gin20TALE+7 | 34 | 5 |
| sN-TALER IV-2 | TVDRSSDPTSQTSGSGGSGTS | Gin20TALE+8 | 36 | 5 |
| sN-TALER IV-2 | TVDRSSDPTSQTSGSGGSGTS | Gin20TALE+9 | 38 | 2 |
| sN-TALER IV-2 | TVDRSSDPTSQTSGSGGSGTS | Gin20TALE+10 | 40 | 1 |
| sN-TALER IV-2 | TVDRSSDPTSQTSGSGGSGTS | Gin20TALE+12 | 44 | 1 |
| sN-TALER IV-2 | TVDRSSDPTSQTSGSGGSGTS | Gin20TALE+15 | 50 | 5 |
| sN-TALER IV-3 | DRSSDPTSQTS | Gin18TALE+0 | 18 | 2 |
| sN-TALER IV-3 | DRSSDPTSQTS | Gin20TALE+0 | 20 | 1 |

TABLE 6-continued

Scoring of bacterial transformants assayed for sN-TALER-mediated recombination of N-TALER reporter constructs.

| N-TALER variant | Linker | Reporter | TALER central sequence length (bp) | Score |
|---|---|---|---|---|
| sN-TALER IV-3 | DRSSDPTSQTS | Gin20TALE+1 | 22 | 4 |
| sN-TALER IV-3 | DRSSDPTSQTS | Gin20TALE+12 | 44 | 1 |
| sN-TALER IV-3.2 | DRSSDPTSQT | Gin18TALE+0 | 18 | 3 |
| sN-TALER IV-3.2 | DRSSDPTSQT | Gin20TALE+0 | 20 | 1 |
| sN-TALER IV-3.2 | DRSSDPTSQT | Gin20TALE+1 | 22 | 4 |
| sN-TALER IV-3.2 | DRSSDPTSQT | Gin20TALE+12 | 44 | 3 |
| sN-TALER IV-4 | DRSSDPTS | Gin18TALE+0 | 18 | 4 |
| sN-TALER IV-4 | DRSSDPTS | Gin20TALE+0 | 20 | 1 |
| sN-TALER IV-4 | DRSSDPTS | Gin20TALE+10 | 40 | 3 |
| sN-TALER IV-4 | DRSSDPTS | Gin20TALE+12 | 44 | 3 |
| sN-TALER IV-5 | SSDPTS | Gin18TALE+0 | 18 | 5 |
| sN-TALER IV-5 | SSDPTS | Gin20TALE+0 | 20 | 4.5 |
| sN-TALER IV-5 | SSDPTS | Gin20TALE+1 | 22 | 5 |
| sN-TALER IV-5 | SSDPTS | Gin20TALE+10 | 40 | 5 |
| sN-TALER IV-5 | SSDPTS | Gin20TALE+12 | 44 | 5 |
| sN-TALER IV-6 | SSDP | Gin18TALE+0 | 18 | 5 |
| sN-TALER IV-6 | SSDP | Gin20TALE+0 | 20 | 5 |
| sN-TALER IV-6 | SSDP | Gin20TALE+1 | 22 | 5 |
| sN-TALER IV-6 | SSDP | Gin20TALE+2 | 24 | 5 |
| sN-TALER IV-6 | SSDP | Gin20TALE+10 | 40 | 5 |
| sN-TALER IV-6 | SSDP | Gin20TALE+12 | 44 | 5 |

The presence of white colonies indicated that N-TALER-mediated recombination had occurred in the reporter construct resulting in a loss of the reporter gene, LacZa. White colonies (score=1 or 1.5) were obtained when sN-TALER IV-1, sN-TALER IV-2, sN-TALER IV-3, sN-TALER IV-3.2, or sN-TALER IV-4 were co-transformed with reporters containing TALER central sequences of 18, 20, 22, 40 or 44 bp in length (Table 7).

TABLE 7 sN-TALER expression construct and reporter construct co-transformation combinations resulting in efficient recombination (all white colonies; score = 1 or 1.5).

| N-TALER | Linker | Reporter construct | TALER central sequence length (bp) | Score |
|---|---|---|---|---|
| sN-TALER IV-1 | TVDRSSDPTSQTS | Gin18TALE+0 | 18 | 1 |
| sN-TALER IV-1 | TVDRSSDPTSQTS | Gin18TALE+1 | 20 | 1 |
| sN-TALER IV-1 | TVDRSSDPTSQTS | Gin20TALE+0 | 20 | 1 |
| sN-TALER IV-1 | TVDRSSDPTSQTS | Gin20TALE+10 | 40 | 1.5 |
| sN-TALER IV-2 | TVDRSSDPTSQTSGSGGSGTS | Gin18TALE+0 | 18 | 1 |

TABLE 7-continued sN-TALER expression construct and reporter construct co-transformation combinations resulting in efficient recombination (all white colonies; score = 1 or 1.5).

| N-TALER | Linker | Reporter construct | TALER central sequence length (bp) | Score |
|---|---|---|---|---|
| sN-TALER IV-2 | TVDRSSDPTSQTSGSGGSGTS | Gin20TALE+0 | 20 | 1 |
| sN-TALER IV-2 | TVDRSSDPTSQTSGSGGSGTS | Gin20TALE+1 | 22 | 1 |
| sN-TALER IV-2 | TVDRSSDPTSQTSGSGGSGTS | Gin20TALE+10 | 40 | 1 |
| sN-TALER IV-2 | TVDRSSDPTSQTSGSGGSGTS | Gin20TALE+12 | 44 | 1 |
| sN-TALER IV-3 | DRSSDPTSQTS | Gin20TALE+0 | 20 | 1 |
| sN-TALER IV-3 | DRSSDPTSQTS | Gin20TALE+12 | 44 | 1 |
| sN-TALER IV-3.2 | DRSSDPTSQT | Gin20TALE+0 | 20 | 1 |
| sN-TALER IV-4 | DRSSDPTS | Gin20TALE+0 | 20 | 1 |

In some sN-TALER expression construct and reporter combinations, sectored colonies were observed (Tables 6 and 8, FIG. 5). Such a result may indicate that recombination was inefficient and/or incomplete, and occurred at a reduced rate during the growth of the colony. The appearance of the sectored colonies was typically white with a blue center, wherein the intensity and diameter of the blue relative to the individual colony size varied (FIG. 5A, B). sN-TALER expression construct and reporter combinations that resulted in sectored colonies with a score of 2 (FIG. 5A) or score of 3 (FIG. 5B), and the length of the N-TALER central sequence are listed in Table 8.

TABLE 8 sN-TALER expression construct and reporter construct co-transformation combinations resulting in sectored colonies.

| N-TALER | LINKER | Reporter construct | TALER central sequence length (bp) | Score |
|---|---|---|---|---|
| sN-TALER IIb-1 | no linker | Gin18TALE+0 | 18 | 3 |
| sN-TALER IV-1 | TVDRSSDPTSQTS | Gin20TALE-T | 20 | 3 |
| sN-TALER IV-1 | TVDRSSDPTSQTS | Gin20TALE+1 | 22 | 2 |
| sN-TALER IV-1 | TVDRSSDPTSQTS | Gin20TALE+2 | 24 | 3 |
| sN-TALER IV-1 | TVDRSSDPTSQTS | Gin20TALE+3 | 26 | 3 |
| sN-TALER IV-1 | TVDRSSDPTSQTS | Gin20TALE+9 | 38 | 2 |
| sN-TALER IV-1 | TVDRSSDPTSQTS | Gin20TALE+12 | 44 | 2 |
| sN-TALER IV-2 | TVDRSSDPTSQTSGSGGSGTS | Gin18TALE+1 | 20 | 2 |
| sN-TALER IV-2 | TVDRSSDPTSQTSGSGGSGTS | Gin20TALE-T | 20 | 3 |
| sN-TALER IV-2 | TVDRSSDPTSQTSGSGGSGTS | Gin20TALE+2 | 24 | 3 |
| sN-TALER IV-2 | TVDRSSDPTSQTSGSGGSGTS | Gin20TALE+3 | 26 | 3 |
| sN-TALER IV-2 | TVDRSSDPTSQTSGSGGSGTS | Gin20TALE+9 | 38 | 2 |
| sN-TALER IV-3 | DRSSDPTSQTS | Gin18TALE+0 | 18 | 2 |
| sN-TALER IV-3.2 | DRSSDPTSQT | Gin18TALE+0 | 18 | 3 |
| sN-TALER IV-3.2 | DRSSDPTSQT | Gin20TALE+10 | 40 | 2 |
| sN-TALER IV-3.2 | DRSSDPTSQT | Gin20TALE+12 | 44 | 3 |

TABLE 8-continued sN-TALER expression construct and reporter construct co-transformation combinations resulting in sectored colonies.

| N-TALER | LINKER | Reporter construct | TALER central sequence length (bp) | Score |
|---|---|---|---|---|
| sN-TALER IV-4 | DRSSDPTS | Gin20TALE+10 | 40 | 3 |
| sN-TALER IV-4 | DRSSDPTS | Gin20TALE+12 | 44 | 3 |

During some of the initial transformations, there were separate batches of growth plates in which the X-Gal substrate differentially applied. In some cases, X-Gal was spread on the plate with an L-spreader, in other cases it was applied using a spray, and in still other cases it was mixed into the molten LB-Agar before the plates were poured. Accordingly, differences in blue intensity were observed between the batches of plates. On some plates, where the X-Gal was applied unevenly, the colonies on some parts of the plate are not uniformly blue. However, this type of coloration was distinguished from sectored colonies and the bacteria were not scored as sectored when this was observed.

PCR was used to confirm that the predicted recombination had occurred in colonies which were white or sectored. PCR primers were designed so that a PCR product of approximately 877 bp (depending on the length of the spacers) would be produced from the non-recombined reporter constructs, and a PCR product of approximately 470 bp would be produced from reporter constructs that had undergone N-TALER-mediated recombination. Standard colony PCR was performed on white, blue, and sectored colonies from several plates representing different pairs of N-TALER expression construct and reporter construct co-transformation combinations.

Figure 6:
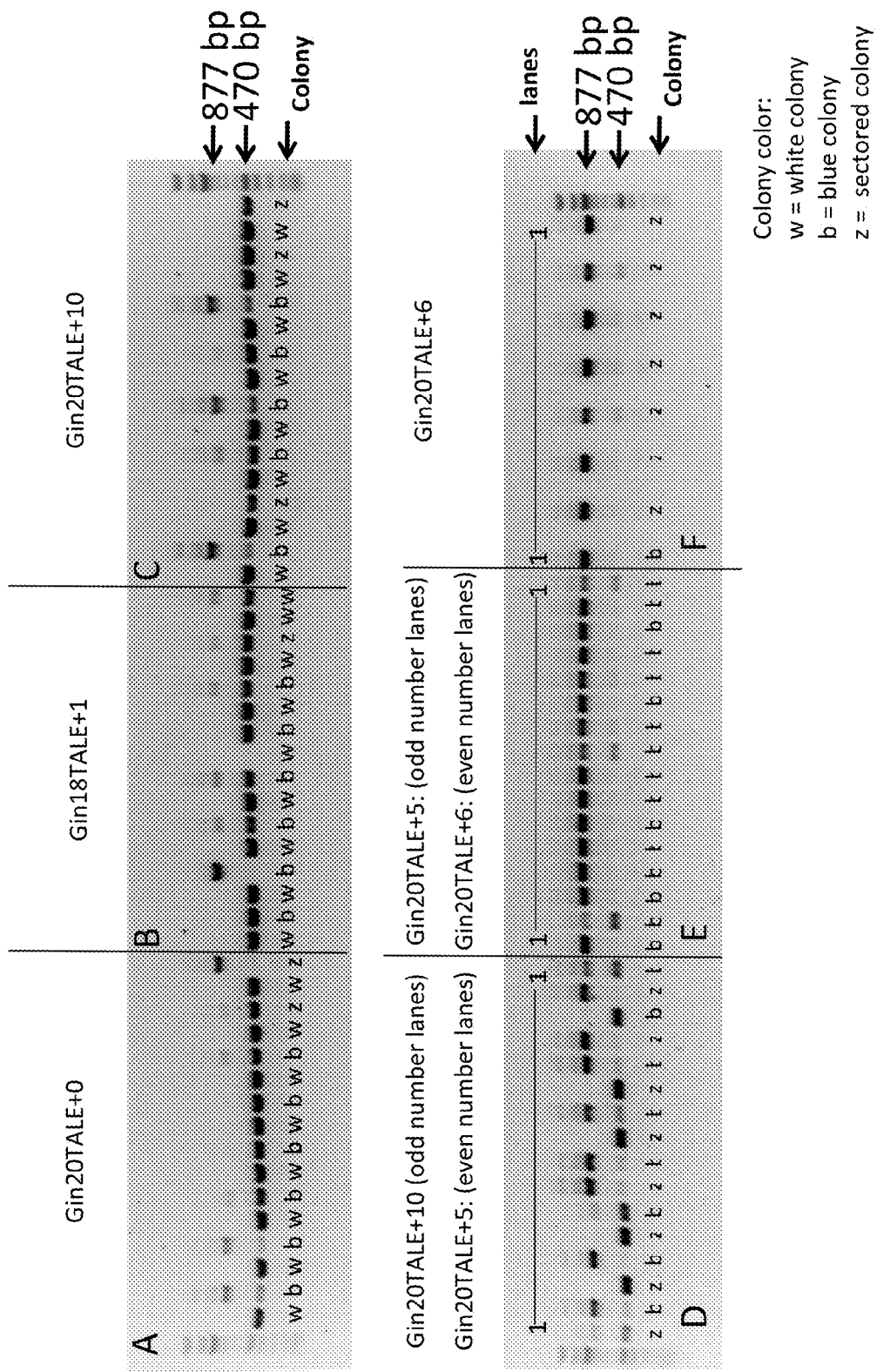
FIG. 6: Agarose gel separation of colony PCR products of several white, sectored, and blue colonies containing N-TALER expression construct sN-TALER IV-1 and N-TALER reporter construct (A) Gin20TALE+0; (B) Gin18TALE+1; (C) Gin20TALE+10; (D) Gin20TALE+10 (odd number lanes) or Gin20TALE+5 (even number lanes); (E) Gin20TALE+5 (odd number lanes) or Gin20TALE+6 (even number lanes); and (F) Gin20TALE+6 (odd number lanes only).

The results of agarose gel separation of the PCR products from colony PCR of several white, sectored, and blue colonies is shown in FIG. 6. For each of the panels, the N-TALER expression construct was sN-TALER IV-1 and the N-TALER reporter construct is as indicated (A: Gin20TALE+0; B: Gin18TALE+1; C: Gin20TALE+10; D: Gin20TALE+10 (odd number lanes) or Gin20TALE+5 (even number lanes); E: Gin20TALE+5 (odd number lanes) or Gin20TALE+6 (even number lanes); and F: Gin20TALE+6 (odd number lanes only). As illustrated in panels A, B, and C, all colony PCR products generated from white colonies gave a single band of the expected size (approximately 470 bp) indicating efficient N-TALER-mediated recombination. (Panel B showed one failed PCR reaction). Colony PCR products generated from blue or sectored colonies demonstrated: (1) no recombination as illustrated by a single ~877 bp band size; (2) inefficient recombination as illustrated by a mixture of 470 bp and 877 bp band sizes; or (3) inefficient or slow recombination (relative to transcription and translation of the LacZα reporter) that appeared to be complete as illustrated by an apparent single 470 bp band size (FIG. 6, panels A-F).

Figure 7:
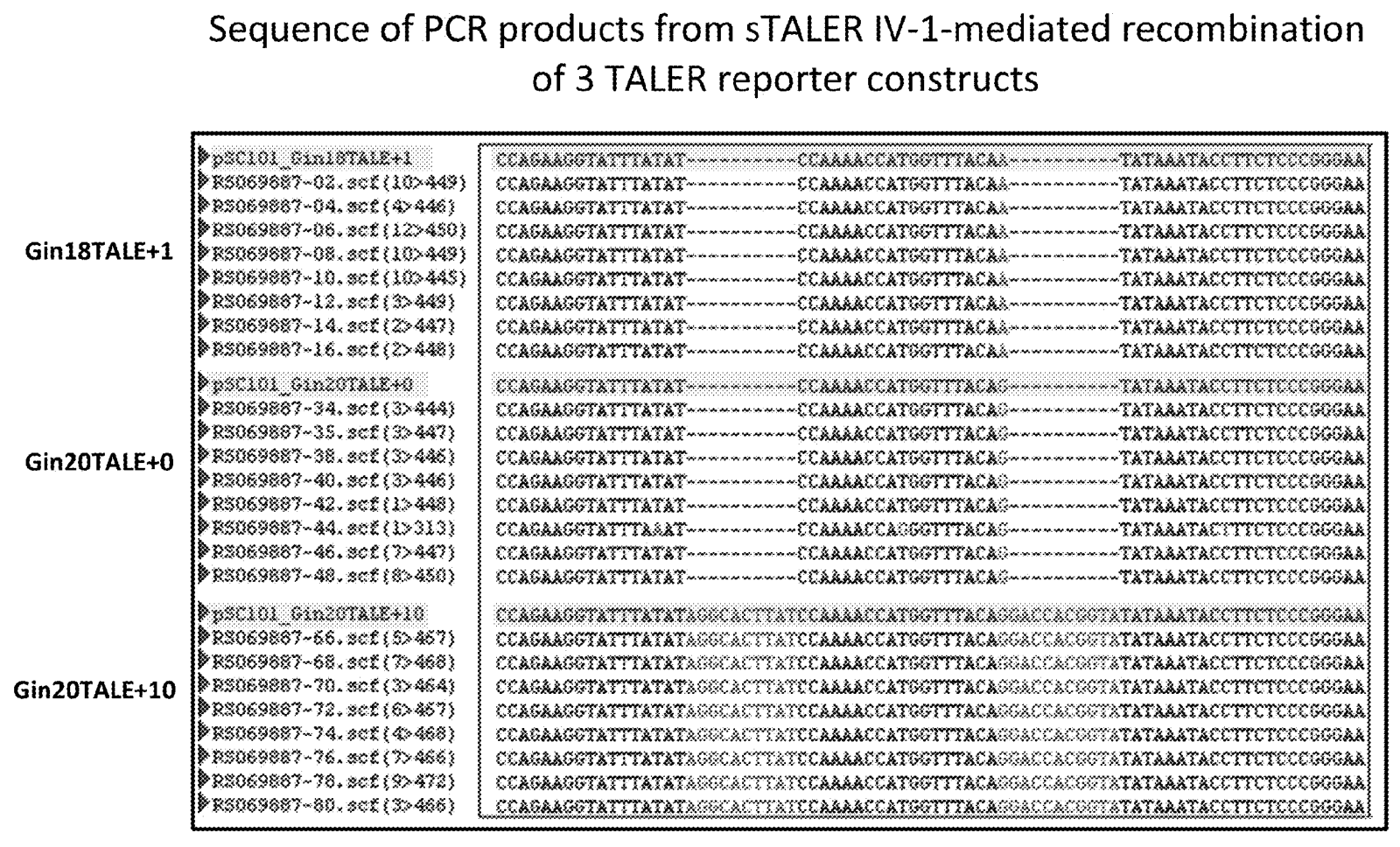

To confirm that the recombination occurred as predicted, several of the PCR products were sequenced. Sequencing results for PCR products generated from white colonies from the sN-TALER IV-1 and Gin18TALE+1; sN-TALER IV-1 and Gin20TALE+0; or sN-TALER IV-1 and Gin20TALE+10 reporter constructs are shown in FIG. 7. No mismatches were detected relative to the predicted recombinase core sequence in any of the PCR products sequenced thereby confirming a base-perfect recombination with N-TALERs (the few single-nucleotide mismatches detected in the sN-TALER IV-1 and Gin20TALE+0 combination were rechecked and consequently dismissed as sequencing error).

Based on the preceding results, it appears that recombination of TALER central sequences about 20 bp in size (e.g., Gin18TALE+0 or Gin20TALE+0), or about 40 bp (i.e., Gin20TALE+10) appear to provide the optimal configuration for complete sN-TALER-mediated recombination (sN-TALER IV-1, sN-TALER IV-2, sN-TALER IV-3, sN-TALER IV-3.2, or sN-TALER IV-4 (Table 7)).

The helical structure of DNA results in one complete DNA helical turn per 10 nucleotide base pairs. This suggests that TALER recombinase catalytic domains can contact their preferred catalytic target sites when they are on the same side of the DNA but not when they are out of phase. For example, when binding N-TALER reporter constructs Gin20TALE+0 or Gin20TALE+10, the recombinase catalytic domains of bound sN-TALER dimers are presumably in phase with the TALER central sequence, thereby allowing recombination to occur. However, when binding N-TALER reporter constructs Gin20TALE+5 or Gin20TALE+15, the recombinase catalytic domains of bound N-TALER dimers are presumably not in phase, thereby prohibiting recombination. This is supported by the data, as evidenced by the efficient recombination (white colonies, score=1 to 1.5) of both N-TALER reporter constructs Gin20TALE+0 and Gin20TALE+10 by sN-TALER IV-1 and IV-2 expression constructs, and yet inefficient recombination (blue colonies, score=5) of both N-TALER reporter constructs Gin20TALE+5 and Gin20TALE+15 (Table 6).

Although the overall pattern of recombination among the different reporter constructs was similar between sN-TALER IV-1 and sN-TALER IV-2, a few differences were noted. The colonies produced by sN-TALER IV-2 with reporter Gin20TALE+4 were sectored, whereas the colonies produced by sN-TALER-IV-1 with reporter Gin20TALE+4 were blue (Table 6). Also, the blue sectors produced with reporter Gin20TALE+9 were much smaller with sN-TALER-IV-2 compared to sN-TALER-IV-1. These differences are likely the result of a longer linker in the sN-TALER IV-2 chimera, which may allow the recombinase catalytic domain to extend further around the DNA helix and contact its preferred catalytic target site when the reporter construct has a TALER central sequence which that is not within the preferred 10-bp helical turn of each half-site of the TALER central sequence.

The presence of a 5'-T is common for TALE binding sites and has been reported as necessary for efficient TALE DNA-binding. It is possible to test the effect of the altered TALE binding site in the two N-TALER reporter constructs, Gin20TALE-T and Gin20TALE+0, where the only difference is the deletion of the 5'-T from the TALE binding site in the former (Table 1). The comparison of TALER-mediated recombination using sN-TALER IV-1 with each of these reporters gave disparate results. Specifically, sectored colonies (score=3) were produced when sN-TALER IV-1 was co-transformed with the Gin20TALE-T reporter construct. By contrast, white colonies (score=1) were produced when sN-TALER IV-1 was co-transformed with the Gin20TALE+0 reporter construct. This result is consistent with poor DNA-binding at the mutated TALE binding site of the Gin20TALE-T reporter construct. The effect of poor DNA-binding at the TALE binding sites would most likely be inefficient tethering of the TALER tetramer, leading to poor recombinase activity.

Varying N-TALER Polypeptide Linker Length

To investigate the effect of polypeptide linker length on N-TALER recombinase efficiency a series of sN-TALER IV variants were created with varying linker sizes (Table 9). sN-TALER IV chimeras were tested with the two reporter constructs, Gin18TALE+0 and Gin20TALE+12, which have TALER central sequence lengths of 18 and 44 bp, respectively (Table 9). The rationale for choosing these two N-TALER reporter constructs was that the reporter construct with the short core (Gin18TALE+0) should function for N-TALERs with shorter polypeptide linkers, while the N-TALER reporter construct with the longer core (Gin20TALE+12) should not. It is postulated that with an N-TALER with a shorter linker, there would be more constraint on the recombinase catalytic domain of the N-TALER chimera, resulting in these recombinase catalytic domains being out-of-phase and therefore, not be in position to form a functional TALER dimer at each single TALER recombination site.

As seen in Table 9, the results indicate that sN-TALER IV-5 and sN-TALER IV-6 did not induce TALER-mediated recombination with either N-TALER reporter construct (blue colonies, score=5). sN-TALER IV-4 displayed inefficient TALER-mediated recombination with both of the N-TALER reporter constructs (sectored colonies, score=3 and 4). sN-TALER IV-3.2 showed incomplete TALER-mediated recombination with both of the N-TALER reporter constructs (sectored colonies, score=3). sN-TALER IV-3 exhibited complete TALER-mediated recombination with the N-TALER reporter Gin20TALE+12 (white colonies, score=1), but somewhat less efficient recombination with reporter GinTALE18+0 (sectored colonies, score=2). sN-TALER IV-1 produced complete TALER-mediated recombination with the N-TALER reporter Gin18TALE+0 (white colonies, score=1), but somewhat less efficient recombination with reporter GinTALE20+12 (sectored colonies, score=2). Finally, sN-TALER IV-2 efficiently recombined both of the TALER reporter constructs tested (white colonies, score=1).

TABLE 9

Assessment of variable polypeptide linker length on N-TALER-mediated recombination efficacy of different TALER central sequences lengths.

| N-TALER variant | Linker | Reporter | Score |
|---|---|---|---|
| sN-TALER IV-1 | TVDRSSDPTSQTS | Gin18TALE+0 | 1 |
| sN-TALER IV-1 | TVDRSSDPTSQTS | Gin20TALE+12 | 2 |

TABLE 9-continued

Assessment of variable polypeptide linker length on N-TALER-mediated recombination efficacy of different TALER central sequences lengths.

| N-TALER variant | Linker | Reporter | Score |
|---|---|---|---|
| sN-TALER IV-2 | TVDRSSDPTSQTSG SGGSGTS | Gin18TALE+0 | 1 |
| sN-TALER IV-2 | TVDRSSDPTSQTSG SGGSGTS | Gin20TALE+12 | 1 |
| sN-TALER IV-3 | DRSSDPTSQTS | Gin18TALE+0 | 2 |
| sN-TALER IV-3 | DRSSDPTSQTS | Gin20TALE+12 | 1 |
| sN-TALER IV-3.2 | DRSSDPTSQT | Gin18TALE+0 | 3 |
| sN-TALER IV-3.2 | DRSSDPTSQT | Gin20TALE+12 | 3 |
| sN-TALER IV-4 | DRSSDPTS | Gin18TALE+0 | 4 |
| sN-TALER IV-4 | DRSSDPTS | Gin20TALE+12 | 3 |
| sN-TALER IV-5 | SSDPTS | Gin18TALE+0 | 5 |
| sN-TALER IV-5 | SSDPTS | Gin20TALE+12 | 5 |
| sN-TALER IV-6 | SSDP | Gin18TALE+0 | 5 |
| sN-TALER IV-6 | SSDP | Gin20TALE+12 | 5 |

Where each row represents a separate transformation recovery/selection plate.

sN-TALERs with varied polypeptide linker lengths were assessed for recombination efficacy on reporter constructs with varied TALER central sequence lengths (Table 6). Results indicated that N-TALERs with shorter linker lengths (i.e., sN-TALER IV-5 or sN-TALER IV-6) were inefficient at recombination with the limited set of N-TALER reporter constructs tested. We speculate that there is greater constraint on the positioning of the recombinase catalytic domain on the TALER central sequence when the N-TALER has a shorter polypeptide linker. sN-TALERs and pN-TALERS are currently being analyzed for recombination efficacy on N-TALER reporter constructs with progressively shorter TALER central sequences (Table 4) to confirm.

N-TALERs with Permissive Recombinase Catalytic Domains

Figure 8:
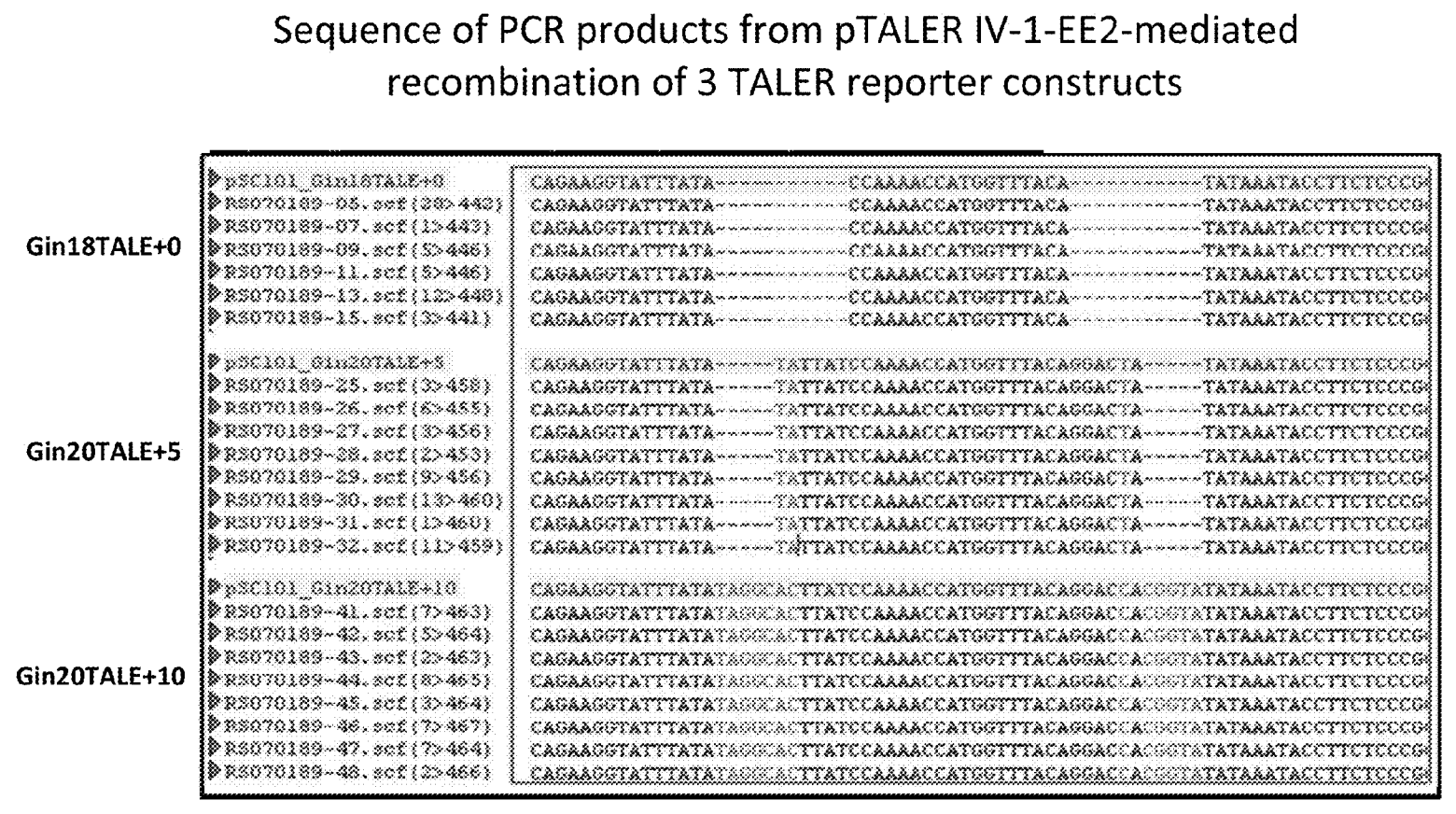

Two additional N-TALERs, based on N-TALER IV-1, were constructed wherein the GinH106Y recombinase catalytic domain was replaced with either the GinL7C7-EE2 catalytic domain or the GinL7C7-EE3 permissive recombinase catalytic domain. These N-TALERs were labeled pN-TALER IV-1-EE2 (SEQ ID NO:41) and pN-TALER IV-1-EE3 (SEQ ID NO:45), respectively. pN-TALER IV-1-EE2 was tested in combination with seventeen N-TALER reporter constructs and pN-TALER IV-1-EE3 was tested with three reporter constructs (Table 10). Results indicated that the pN-TALER IV-1-EE2 showed variable recombination efficiency which was N-TALER reporter construct dependent (white, sectored, and blue colonies, score range=1-5; Table 10). Colony PCR of 8 colonies from each plate co-transformed with pN-TALER IV-1-EE2 (SEQ ID NO:41) and N-TALER reporters Gin18TALE+0, Gin20TALE+5, and Gin20TALE+10 revealed expected 470 bp PCR products indicating efficient TALER-mediated recombination. DNA sequencing analysis further revealed that all recombination events were normal (FIG. 8).

TABLE 10

Scoring of bacterial transformants assayed for pN-TALER IV-1-EE2- and pN-TALER IV-1-EE3-mediated recombination of N-TALER reporter constructs.

| N-TALER variant | Linker | Reporter | TALER central sequence length (bp) | Score |
|---|---|---|---|---|
| pN-TALER IV-1-EE2 | TVDRSSDPTSQTS | GinC6 | | 5 |
| pN-TALER IV-1-EE2 | TVDRSSDPTSQTS | Gin18TALE+0 | 18 | 1 |
| pN-TALER IV-1-EE2 | TVDRSSDPTSQTS | Gin18TALE+1 | 20 | 1 |
| pN-TALER IV-1-EE2 | TVDRSSDPTSQTS | Gin20TALE-T | 20 | 5 |
| pN-TALER IV-1-EE2 | TVDRSSDPTSQTS | Gin20TALE+0 | 20 | 1 |
| pN-TALER IV-1-EE2 | TVDRSSDPTSQTS | Gin20TALE+1 | 22 | 1 |
| pN-TALER IV-1-EE2 | TVDRSSDPTSQTS | Gin20TALE+2 | 24 | 1 |
| pN-TALER IV-1-EE2 | TVDRSSDPTSQTS | Gin20TALE+3 | 26 | 1 |
| pN-TALER IV-1-EE2 | TVDRSSDPTSQTS | Gin20TALE+4 | 28 | 1.5 |
| pN-TALER IV-1-EE2 | TVDRSSDPTSQTS | Gin20TALE+5 | 30 | 1 |
| pN-TALER IV-1-EE2 | TVDRSSDPTSQTS | Gin20TALE+6 | 32 | 2 |
| pN-TALER IV-1-EE2 | TVDRSSDPTSQTS | Gin20TALE+7 | 34 | 2.5 |
| pN-TALER IV-1-EE2 | TVDRSSDPTSQTS | Gin20TALE+8 | 36 | 2.5 |
| pN-TALER IV-1-EE2 | TVDRSSDPTSQTS | Gin20TALE+9 | 38 | 2 |
| pN-TALER IV-1-EE2 | TVDRSSDPTSQTS | Gin20TALE+10 | 40 | 1 |
| pN-TALER IV-1-EE2 | TVDRSSDPTSQTS | Gin20TALE+12 | 44 | 2 |
| pN-TALER IV-1-EE2 | TVDRSSDPTSQTS | Gin20TALE+15 | 50 | 5 |
| pN-TALER IV-5-EE2 | SSDPTS | Gin20TALE+0 | 20 | 1 |
| pN-TALER IV-6-EE2 | SSDP | Gin20TALE+0 | 20 | 1** |
| pN-TALER IV-8-EE2 | No linker | Gin20TALE+0 | 20 | 5## |
| pN-TALER IV-1-EE3 | TVDRSSDPTSQTS | Gin18TALE+0 | 18 | 3 |
| pN-TALER IV-1-EE3 | TVDRSSDPTSQTS | Gin20TALE+5 | 30 | 5 |
| pN-TALER IV-1-EE3 | TVDRSSDPTSQTS | Gin20TALE+10 | 40 | 5 |

**Almost all the colonies on this plate had a small light blue spot at their center. The phenotype of a central small light blue spot was produced in two additional transformations. This light blue spot did not have the typical "star-like" pattern of sectored colonies. Furthermore, when these colonies were streaked out, they were completely white and PCR analysis indicated that the reporter was recombined. Thus, while not completely white, this plate was scored as a 1 because the reporter constructs in all colonies appear to have undergone complete recombination.
The colonies on this plate were all blue but the intensity was lighter than controls containing only the reporter (lacking the recombinase). When several colonies were streaked out, they remained a light blue color. Furthermore, PCR indicated that the reporter constructs were not recombined.

To confirm that TALE binding is required to direct TALER-mediated recombination within the TALER central sequence, the GinC6 reporter construct was co-transformed with pN-TALER IV-1-EE2 chimera expression plasmid (Table 10). This reporter contains the Gin core sequence which is flanked by zinc finger binding sites and not by TALE13 binding sites (Table 1). Only blue colonies were produced. This result demonstrates that correct TALE binding is required for TALER-mediated recombination by the permissive recombinase catalytic domain.

Potential applications of using a permissive N-TALER chimera, for example those made with the GinL7C7-EE2 recombinase catalytic domain, could be targeted gene insertion and targeted DNA removal as well as targeted genome alterations included directed recombination to link or unlink specific haplotypes.

Although several of the reporter constructs were not recombined with sN-TALER IV-1 (including Gin20TALE+5) all of the N-TALER reporter constructs, except Gin20TALER+15, GinC6, and Gin20TALE-T, were recombined with the pN-TALER IV-1-EE2 to a substantial degree (Table 10). The N-TALER reporter construct Gin20TALER+0 also demonstrated complete, or nearly complete, TALER-mediated recombination by pN-TALER IV-5-EE2, and pN-TALER IV-6-EE2 (Table 11). In contrast, neither of the sN-TALER expression constructs, sN-TALER IV-5 or sN-TALER IV-6, demonstrated any recombination with the Gin20TALER+0 reporter construct (Table 11). Optimal pN-TALER-mediated recombination was observed for TALER core sites that were approximately 20 bp, approximately 30 bp, and approximately 40 bp. These maxima have a periodicity of 10 bp (Table 11). These results demonstrate that the permissive recombinase catalytic domain of the pN-TALER chimeras mediate recombination at a wider range of TALER central sequence lengths than does that of the restrictive recombinase catalytic domain of sN-TALER chimeras.

TABLE 11

Comparison of sN-TALER- and pN-TALER-mediated recombination efficiency.

| N-TALER variant | Reporter | TALER central sequence length (bp) | Score |
|---|---|---|---|
| sN-TALER IV-1 | Gin18TALE+0 | 18 | 1 |
| sN-TALER IV-1 | Gin20TALE+5 | 30 | 5 |
| sN-TALER IV-1 | Gin20TALE+10 | 40 | 1.5 |
| sN-TALER IV-5 | Gin20TALE+0 | 20 | 4.5 |
| sN-TALER IV-6 | Gin20TALE+0 | 20 | 5 |
| pN-TALER IV-1-EE2 | Gin18TALE+0 | 18 | 1 |
| pN-TALER IV-1-EE2 | Gin20TALE+5 | 30 | 1 |
| pN-TALER IV-1-EE2 | Gin20TALE+10 | 40 | 1 |
| pN-TALER IV-5-EE2 | Gin20TALE+0 | 20 | 1 |
| pN-TALER IV-6-EE2 | Gin20TALE+0 | 20 | 1** |
| pN-TALER IV-1-EE3 | Gin18TALE+0 | 18 | 3 |
| pN-TALER IV-1-EE3 | Gin20TALE+5 | 30 | 5 |
| pN-TALER IV-1-EE3 | Gin20TALE+10 | 40 | 5 |

**see Table 10.

In contrast to the results obtained with pN-TALERIV-1-EE2, pN-TALER IV-1-EE3 did not produce all white colonies with any of the three N-TALER reporter constructs tested. Only the combination of pN-TALER IV-1-EE3 with the Gin18TALE+0 reporter construct resulted in any recombination activity (sectored colonies; Table 10). These results may indicate that pN-TALER IV-1-EE3 may have a diminished TALER central sequence DNA-binding affinity as a consequence of the mutations which enabled permissive recombinase catalytic activity. It is possible that the long polypeptide linker used to create pN-TALER IV-1-EE3 prohibits the recombinase catalytic domain from stably interacting with the DNA substrate to allow for efficient TALER-mediated recombination. It is possible that shortening the polypeptide linker tethered to the permissive GinL7C7-EE3 recombinase catalytic domain may improve functionality.

Additionally, other permissive Gin recombinase catalytic domains are known and can be tested. Using molecular evolution methods, permissive versions of Tn3, hin, cin, or any of the other recombinase family members or, indeed, any of the serine recombinase family members, could be found. For example, a Tn3 variant with substantially, although not completely, relaxed specificity has been described (Proudfoot et al., 2011). To confirm and explore the relaxed specificity of the permissive recombinase catalytic domains in the pN-TALERs, an additional series of N-TALER reporter constructs will be generated wherein the TALER central sequence will be varied.

N-TALERs with TALE Truncations Sites I, II, and III

N-terminal truncations that occur 3' of the QQQQ motif in the N-terminal region of native TALE proteins have been reported by others to eliminate TALE binding (International Publication No. WO2011146121; Sun et al., 2012). In contrast to these reports, we observed a very low level of TALER-mediated recombinase activity with sN-TALER chimeras made with N-terminal truncations at sites—I, IIa, IIb, and III (FIG. 2) when co-transformed with several of the N-TALER reporter constructs, as evidenced by sectoring (scores of 3 and 4) (Table 6). Colony PCR results demonstrated the presence of bands of approximate size of 470 bp, confirming that TALER-mediated recombination had occurred. These results suggest that TALE binding is less efficient with these sN-TALER chimeras due to the N-terminal deletions of the TALE domain. Alternatively, it is possible that the TALER core recombination sites, even with an 18 bp core, are too long for the N-TALER chimeras with these additional N-terminal TALE deletions. Experiments can be designed to test this possibility, wherein the N-TALER reporter constructs are designed to contain shorter core recombination sites (Table 4).

Example 4

TALER Chimeras can be Highly Specific and Easily Programmable

The focus of recent effort to create a zinc finger recombinase (ZFR) which is more highly specific for the sequence it is designed to recombine has been to alter the DNA specificity of the catalytic domain using molecular evolution (Gordley et al., 2007; Proudfoot et al., 2011). These molecular evolution efforts with the ZFRs have been designed to make reagents for gene therapy applications that are highly precise and predictable. The combination of DNA-binding specificity derived from the ZF domains combined with the modified recombinase catalytic domain with altered, but not eliminated, sequence specificity, may produce the desired level of DNA target site specificity in these ZFRs. This approach requires effort to engineer the recombinase catalytic domain anew for every new DNA target. In contrast, TALERs take advantage of the high levels of specificity of DNA-binding due to the TALE DNA-binding domain to confer specificity to the positioning of the recombinase catalytic domain. Accordingly, a highly permissive recombinase catalytic domain can be combined with TALE binding domains such that all of the specificity is conferred by the TALE domain and the resulting TALER will retain sufficient levels of recombinase-mediated sequence specificity. Thus, a TALER with a permissive recombinase catalytic domain combines specificity and ease of design.

As the results described in Example 3 illustrate, the efficiency of TALER-mediated recombination is dependent on multiple factors interacting in 3-dimension wherein, a two-domain protein binds as a dimer at a single TALER DNA-binding site, functional as a tetramer bringing together two TALER DNA-binding sites, whereby there occurs a recombinase-mediated catalytic recombination between specified sites on a DNA helix. One variable factor is the length of the spacer component of the TALER core recombinase site. Another is the sequence of the TALER central sequence. Others are properties, such as length, flexibility, or ionic charge, of the amino acid linker of the TALER which tethers the TALE binding domain to the recombinase catalytic domain. And yet another is the specificity versus permissiveness of the recombinase catalytic domain, which is related to the DNA sequence of the TALER core binding site.

Varying the Polypeptide Linker in TALERs

It has been reported that there is a relatively confined length of the amino acid linker in zinc finger recombinase (ZFR) fusion proteins which were tolerated for efficient recombination in the respective assay systems (Gordley et al., 2007; Akopian et al., 2003). In contrast to these published reports, the data presented herein with TALERs, there is a larger range in the length of the amino acid linker for the TALER chimeras which are functional for recombination of the TALER reporter constructs. For example, TALER IV-2 (linker of 21 amino acids) appeared to have greater recombination frequency at some TALER central sequence lengths than TALER IV-1 (linker of 13 amino acids) (Table 6). Testing different protein linkers that are longer, shorter or are less flexible in TALER chimeras in pair-wise analysis with TALER reporter constructs to define optimal linker sizes for optimal TALER-mediated recombinase efficiency at differing TALER central sequence lengths is being conducted.

TALER chimeras containing linkers of various lengths in combination with the GinL7C7-EE2-recombinase catalytic domain will be designed and tested. The testing of the differing linkers with the pN-TALER IV-1-EE2 chimera will determine what maximum and minimum TALER central sequence lengths are needed for efficient TALER-mediated recombination. It will be expected that there will be a larger range of TALER central sequence lengths which are able to be efficiently recombined with differing linkers of pN-TALER IV-1-EE2 chimera variants when compared to sN-TALER IV-1 with the same set of linkers.

To investigate the length of the linkers in N-TALER chimeras which would still provide for efficient recombination, sN-TALER and pN-TALER chimeras were constructed with linkers of 31, 43, 53, 61, 71, and 81 amino acids (Table 12).

TABLE 12

N-TALER chimeras with polypeptide linkers of varying length.

| TALER variant | TALE N-terminal site | Linker | Recombinase | Nucleotide SEQ ID NO: | Protein SEQ ID NO: |
|---|---|---|---|---|---|
| sN-TALER IV-10 | IV | TVDRSSDPTSQTSTSRDGSDPGSG SGGSGTS | GinH106Y | 137 | 148 |
| sN-TALER IV-11 | IV | TVDRSSDPTSQTSTSRDGSDPTVS TQGSGTSGGGSGSGGSGTS | GinH106Y | 138 | 149 |
| sN-TALER IV-12 | IV | TVDRSSDPTSQTSTSRDGSDPTVS TQGSGTSGGTPDSSTQGSGGSGS GGSGTS | GinH106Y | 139 | 150 |
| sN-TALER IV-13 | IV | TVDRSSDPTSQTSTSRDGSDPTVS TQGSGTSGGTPDSSTQGSGVSRD PVSTGSGSGGSGTS | GinH106Y | 140 | 151 |
| sN-TALER IV-14 | IV | TVDRSSDPTSQTSTSRDGSDPTVS TQGSGTSGGTPDSSTQGSGVSRD PVSTGSGRTVDPGSGSGSGGSGTS | GinH106Y | 141 | 152 |
| sN-TALER IV-15 | IV | TVDRSSDPTSQTSTSRDGSDPTVS TQGSGTSGGTPDSSTQGSGVSRD PVSTGSGRTVDPGSGSGSRQTPVS SGGSGGSGTS | GinH106Y | 142 | 153 |
| pN-TALER IV-10 | IV | TVDRSSDPTSQTSTSRDGSDPGSG SGGSGTS | GinL7C7-EE2 | 143 | 154 |
| pN-TALER IV-11 | IV | TVDRSSDPTSQTSTSRDGSDPTVS TQGSGTSGGGSGSGGSGTS | GinL7C7-EE2 | 144 | 155 |
| pN-TALER IV-12 | IV | TVDRSSDPTSQTSTSRDGSDPTVS TQGSGTSGGTPDSSTQGSGGSGS GGSGTS | GinL7C7-EE2 | 145 | 156 |
| pN-TALER IV-13 | IV | TVDRSSDPTSQTSTSRDGSDPTVS TQGSGTSGGTPDSSTQGSGVSRD PVSTGSGSGGSGTS | GinL7C7-EE2 | 146 | 157 |
| pN-TALER IV-14 | IV | TVDRSSDPTSQTSTSRDGSDPTVS TQGSGTSGGTPDSSTQGSGVSRD PVSTGSGRTVDPGSGSGSGGSGTS | GinL7C7-EE2 | 147 | 158 |

The N-TALER expression constructs representing the N-TALER chimeras with varying linker lengths were co-transformed with N-TALER reporter constructs with TALER central sequence lengths of 18, 20, 24, 30, 40, and 50 bp (Table 13). As can be seen from Table 13, each of the sN-TALER chimeras were able to efficiently recombine each of the different N-TALER reporter constructs tested, suggesting that linker length is not a constraint for sN-TALER-mediated recombination. Similarly, the pN-TALER chimeras with linker lengths of 31, 43, 53, and 61 amino acids efficiently recombined each of the different N-TALER reporter constructs tested, suggesting that linker lengths of up about 61 amino acids is not a constraint for pN-TALER-mediated recombination. Recombination did occur, but was less efficient with the pN-TALER IV-14 (linker length of 71 amino acids) with each of the N-TALER reporters tested.

requirements may produce TALERs that recombine at a specific and predictable nucleotide within the core allowing the reading frame to be preserved in all (or most) recombination events.

After this initial characterization of linkers of differing length, linkers with other properties such as flexibility, rigidity, and ionic charge will be considered for testing.

Varying TALE Protein N-Terminal Deletions

It is possible to vary the length of the N-terminal deletions of the TALE domain and still produce TALERs efficient at mediating recombination at unique and specific TALER central sequences. It is speculated that if TALER-mediated recombination is inefficient due to an over-truncated TALE protein N-terminus, then the TALER-mediated recombina-

TABLE 13

Recombination efficiency of N-TALER chimeras with varying linker lengths.

| Reporter | TALER central sequence length (bp) | sN-TALER variant | Score | Reporter | TALER central sequence length (bp) | pN-TALER variant | Score |
|---|---|---|---|---|---|---|---|
| Gin18TALE+0 | 18 | sN-TALER IV-10 | 1 | Gin18TALE+1 | 20 | pN-TALER IV-10 | 1 |
| Gin20TALE+0 | 20 | sN-TALER IV-10 | 1 | Gin20TALE+2 | 24 | pN-TALER IV-10 | 1 |
| Gin20TALE+5 | 30 | sN-TALER IV-10 | 3 | Gin20TALE+5 | 30 | pN-TALER IV-10 | 1 |
| Gin20TALE+10 | 40 | sN-TALER IV-10 | 1 | Gin20TALE+10 | 40 | pN-TALER IV-10 | 1 |
| Gin20TALE+15 | 50 | sN-TALER IV-10 | 5 | Gin20TALE+15 | 50 | pN-TALER IV-10 | 1 |
| Gin18TALE+0 | 18 | sN-TALER IV-11 | 1 | Gin18TALE+0 | 18 | pN-TALER IV-11 | 1 |
| Gin20TALE+0 | 20 | sN-TALER IV-11 | 1 | Gin20TALE+0 | 20 | pN-TALER IV-11 | 1 |
| Gin20TALE+5 | 30 | sN-TALER IV-11 | 1 | Gin20TALE+5 | 30 | pN-TALER IV-11 | 1 |
| Gin20TALE+10 | 40 | sN-TALER IV-11 | 1 | Gin20TALE+10 | 40 | pN-TALER IV-11 | 1 |
| Gin20TALE+15 | 50 | sN-TALER IV-11 | 1 | Gin20TALE+15 | 50 | pN-TALER IV-11 | 2 |
| Gin18TALE+0 | 18 | sN-TALER IV-12 | 1 | Gin18TALE+0 | 18 | pN-TALER IV-12 | 1 |
| Gin20TALE+0 | 20 | sN-TALER IV-12 | 1 | Gin20TALE+0 | 20 | pN-TALER IV-12 | 1 |
| Gin20TALE+5 | 30 | sN-TALER IV-12 | 1 | Gin20TALE+5 | 30 | pN-TALER IV-12 | 1 |
| Gin20TALE+10 | 40 | sN-TALER IV-12 | 1 | Gin20TALE+10 | 40 | pN-TALER IV-12 | 1 |
| Gin20TALE+15 | 50 | sN-TALER IV-12 | 1 | Gin20TALE+15 | 50 | pN-TALER IV-12 | 1 |
| Gin18TALE+0 | 18 | sN-TALER IV-13 | 1 | Gin18TALE+0 | 18 | pN-TALER IV-13 | 1 |
| Gin20TALE+0 | 20 | sN-TALER IV-13 | 1 | Gin20TALE+0 | 20 | pN-TALER IV-13 | 1 |
| Gin20TALE+5 | 30 | sN-TALER IV-13 | 1 | Gin20TALE+5 | 30 | pN-TALER IV-13 | 1 |
| Gin20TALE+10 | 40 | sN-TALER IV-13 | 1 | Gin20TALE+10 | 40 | pN-TALER IV-13 | 1 |
| Gin20TALE+15 | 50 | sN-TALER IV-13 | 1 | Gin20TALE+15 | 50 | pN-TALER IV-13 | 2 |
| Gin18TALE+0 | 18 | sN-TALER IV-14 | 1.5 | Gin18TALE+0 | 18 | pN-TALER IV-14 | 3 |
| Gin20TALE+0 | 20 | sN-TALER IV-14 | 1.5 | Gin20TALE+0 | 20 | pN-TALER IV-14 | 3 |
| Gin20TALE+5 | 30 | sN-TALER IV-14 | 2 | Gin20TALE+5 | 30 | pN-TALER IV-14 | 3 |
| Gin20TALE+10 | 40 | sN-TALER IV-14 | 2 | Gin20TALE+10 | 40 | pN-TALER IV-14 | 3 |
| Gin20TALE+15 | 50 | sN-TALER IV-14 | 2 | Gin20TALE+15 | 50 | pN-TALER IV-14 | 4 |
| Gin18TALE+0 | 18 | sN-TALER IV-15 | 1 | | | | |
| Gin20TALE+0 | 20 | sN-TALER IV-15 | 1 | | | | |
| Gin20TALE+5 | 30 | sN-TALER IV-15 | 1.5 | | | | |
| Gin20TALE+10 | 40 | sN-TALER IV-15 | 1.5 | | | | |
| Gin20TALE+15 | 50 | sN-TALER IV-15 | 1 | | | | |

A library of linkers is currently being produced and tested. This library will be made with TALER chimeras with both permissive and non-permissive recombinase catalytic domains. This collection will enable different applications that may have different requirements for stringency of spacer length. For example, for developing reagents to do gene-targeting to non-genic chromosomal regions, a TALER chimera with very relaxed spacer length requirements would be ideal. For gene modifications that requires altering coding sequences without disrupting the reading frame, tight spacer tion assay system described herein can be used as part of a molecular evolution or protein design approach to identity changes to the residual TALE protein N-terminus that will restore efficient DNA-binding while retaining a truncated N-terminus.

N-TALERs with TALE Truncations Sites V, N3.2, N4.2, N4.2.2, and N5.2

A series of N-TALER chimeras were generated where the N-terminal truncation point of the TALE DNA-binding domain was varied (FIG. 9; Table 14).

TABLE 14

N-TALER chimeras.

| N-TALER | TALE N-terminal site | Linker | Recombinase | Nucleotide SEQ ID NO: | Protein SEQ ID NO: |
|---|---|---|---|---|---|
| sN-TALER V.2 | V.2 | TVDRSSDPTSQTSGSGGSGTS | GinH106Y | 159 | 169 |
| sN-TALER N3.2 | N3.2 | TVDRSSDPTSQTSGSGGSGTS | GinH106Y | 160 | 170 |
| sN-TALER N4.2 | N4.2 | TVDRSSDPTSQTSGSGGSGTS | GinH106Y | 161 | 171 |
| sN-TALER N4.2.2 | N4.2.2 | TVDRSSDPTSQTSGSGGSGTS | GinH106Y | 162 | 172 |
| sN-TALER N5.2 | N5.2 | TVDRSSDPTSQTSGSGGSGTS | GinH106Y | 163 | 173 |
| pN-TALER V.2 | V.2 | TVDRSSDPTSQTSGSGGSGTS | GinL7C7-EE2 | 164 | 174 |
| pN-TALER N3.2 | N3.2 | TVDRSSDPTSQTSGSGGSGTS | GinL7C7-EE2 | 165 | 175 |
| pN-TALER N4.2 | N4.2 | TVDRSSDPTSQTSGSGGSGTS | GinL7C7-EE2 | 166 | 176 |
| pN-TALER N4.2.2 | N4.2.2 | TVDRSSDPTSQTSGSGGSGTS | GinL7C7-EE2 | 167 | 177 |
| pN-TALER N5.2 | N5.2 | TVDRSSDPTSQTSGSGGSGTS | GinL7C7-EE2 | 168 | 178 |

For each of these N-TALER chimera expression constructs, from one to three independent clones were selected for plasmid purification. These N-TALER chimera expression constructs were co-transformed with five of the N-TALER reporter constructs, as indicated in Table 15. There was no recombination for any of the N-TALER reporters tested for the chimeras sN-TALER N5.2 and pN-TALER N5.2, as seen by blue colonies with a score of 5. There was no recombination for any of the N-TALER reporters tested for the chimera pN-TALER N4.2.2 as seen by blue colonies with a score of 5. In contrast to the result for pN-TALER N4.2.2, the chimera sN-TALER N4.2.2, with the same truncation point but a specific recombinase catalytic domain, reporters with 20, 24, or 40 bp of TALER central sequence length were efficiently recombined (score of 1) while reporters with 30 or 50 bp of TALER central sequence length were not recombined (score of 5). For the chimera sN-TALER N4.2, reporters with 20, 24, or 40 bp of TALER central sequence length were efficiently recombined (score of 1); the reporter with 30 bp of TALER central sequence length was poorly recombined (score of 3); and the reporter with 50 bp of TALER central sequence length was not recombined (score of 5). For the chimera pN-TALER N4.2, the recombination efficiency on the reporters tested varied from intermediate (scores of 3 and 4) to none (score of 5). For chimera sN-TALER N3.2, three separate clones showed no recombination of any of the N-TALER reporters tested (score of 5). In contrast to the result for sN-TALER N3.2, the chimera pN-TALER N3.2, with the same truncation point but a permissive recombinase catalytic domain, recombination efficiency on the reporters tested varied from efficient (scores of 1.5, 2, and 3) to none (score of 5). For both chimeras sN-TALER V.2 and pN-TALER V.2, there was efficient recombination (scores of 1, 1.5, and 2) of the 5 N-TALER reporter constructs tested.

TABLE 15

Recombination efficiency of TALE DNA-binding domain N-terminal deletions.

| N-TALER variant | Number of clones tested | Reporter | TALER central sequence length (bp) | Score |
|---|---|---|---|---|
| sN-TALER V.2 | 1 | Gin18TALE+1 | 20 | 1 |
| sN-TALER V.2 | 1 | Gin20TALE+2 | 24 | 1 |
| sN-TALER V.2 | 1 | Gin20TALE+5 | 30 | 1 |
| sN-TALER V.2 | 1 | Gin20TALE+10 | 40 | 1 |
| sN-TALER V.2 | 1 | Gin20TALE+15 | 50 | 1.5 |
| sN-TALER N3.2 | 3 | Gin18TALE+1 | 20 | 5 |
| sN-TALER N3.2 | 3 | Gin20TALE+2 | 24 | 5 |
| sN-TALER N3.2 | 3 | Gin20TALE+5 | 30 | 5 |
| sN-TALER N3.2 | 3 | Gin20TALE+10 | 40 | 5 |
| sN-TALER N3.2 | 3 | Gin20TALE+15 | 50 | 5 |
| sN-TALER N4.2 | 1 | Gin18TALE+1 | 20 | 1 |
| sN-TALER N4.2 | 1 | Gin20TALE+2 | 24 | 1 |
| sN-TALER N4.2 | 1 | Gin20TALE+5 | 30 | 3 |
| sN-TALER N4.2 | 1 | Gin20TALE+10 | 40 | 1 |
| sN-TALER N4.2 | 1 | Gin20TALE+15 | 50 | 5 |
| sN-TALER N4.2.2 | 1 | Gin18TALE+1 | 20 | 1 |
| sN-TALER N4.2.2 | 1 | Gin20TALE+2 | 24 | 1 |
| sN-TALER N4.2.2 | 1 | Gin20TALE+5 | 30 | 5 |
| sN-TALER N4.2.2 | 1 | Gin20TALE+10 | 40 | 1 |
| sN-TALER N4.2.2 | 1 | Gin20TALE+15 | 50 | 5 |
| sN-TALER N5.2 | 3 | Gin18TALE+1 | 20 | 5 |
| sN-TALER N5.2 | 3 | Gin20TALE+2 | 24 | 5 |
| sN-TALER N5.2 | 3 | Gin20TALE+5 | 30 | 5 |
| sN-TALER N5.2 | 3 | Gin20TALE+10 | 40 | 5 |
| sN-TALER N5.2 | 3 | Gin20TALE+15 | 50 | 5 |
| pN-TALER V.2 | 1 | Gin18TALE+1 | 20 | 1 |
| pN-TALER V.2 | 1 | Gin20TALE+2 | 24 | 1 |
| pN-TALER V.2 | 1 | Gin20TALE+5 | 30 | 1 |
| pN-TALER V.2 | 1 | Gin20TALE+10 | 40 | 1 |
| pN-TALER V.2 | 1 | Gin20TALE+15 | 50 | 2 |
| pN-TALER N3.2 | 1 | Gin18TALE+1 | 20 | 3 |
| pN-TALER N3.2 | 1 | Gin20TALE+2 | 24 | 3 |
| pN-TALER N3.2 | 1 | Gin20TALE+5 | 30 | 1.5 |
| pN-TALER N3.2 | 1 | Gin20TALE+10 | 40 | 2 |
| pN-TALER N3.2 | 1 | Gin20TALE+15 | 50 | 5 |
| pN-TALER N4.2 | 1 | Gin18TALE+1 | 20 | 3 |
| pN-TALER N4.2 | 1 | Gin20TALE+2 | 24 | 3 |
| pN-TALER N4.2 | 1 | Gin20TALE+5 | 30 | 3 |
| pN-TALER N4.2 | 1 | Gin20TALE+10 | 40 | 4 |
| pN-TALER N4.2 | 1 | Gin20TALE+15 | 50 | 5 |
| pN-TALER N4.2.2 | 1 | Gin18TALE+1 | 20 | 5 |

TABLE 15-continued

Recombination efficiency of
TALE DNA-binding domain N-terminal deletions.

| N-TALER variant | Number of clones tested | Reporter | TALER central sequence length (bp) | Score |
|---|---|---|---|---|
| pN-TALER N4.2.2 | 1 | Gin20TALE+2 | 24 | 5 |
| pN-TALER N4.2.2 | 1 | Gin20TALE+5 | 30 | 5 |
| pN-TALER N4.2.2 | 1 | Gin20TALE+10 | 40 | 5 |
| pN-TALER N4.2.2 | 1 | Gin20TALE+15 | 50 | 5 |
| pN-TALER N5.2 | 2 | Gin18TALE+1 | 20 | 5 |
| pN-TALER N5.2 | 2 | Gin20TALE+2 | 24 | 5 |
| pN-TALER N5.2 | 2 | Gin20TALE+5 | 30 | 5 |
| pN-TALER N5.2 | 2 | Gin20TALE+10 | 40 | 5 |
| pN-TALER N5.2 | 2 | Gin20TALE+15 | 50 | 5 |

Varying TALER Hyperactive Recombinase Catalytic Domains

It is possible to design and generate additional TALER chimeras where the recombinase catalytic domain is selected from any number of other hyperactive recombinase genes, either permissive or selective. With five hyperactive catalytic domains already reported, it is anticipated that many, if not all, of the more than 30 serine recombinases in the resolvase/invertase family are suitable for use in generating TALER chimeras as reported herein. Hyperactive serine recombinase catalytic domains that can be used to construct TALER chimeras include: Hin (HinH106Y, referred to herein as HinB) invertase, the Tn3 resolvase and mutants (G70S, D102Y, and E124Q), the Sin recombinase, γδ resolvase, Tn21 resolvase, β resolvase, ISXc5 resolvase, *Methanococcus jannaschii* resolvase, IS607 resolvase, ccrA1 resolvase, TN4451 resolvase, TP901-1 resolvase, or φC31 resolvase.

Two N-TALER chimeras were generated wherein the recombinase catalytic domain comprised either the HinB or HinC (a HinB with additional mutations) invertase catalytic domain (Table 16). Each of these N-TALER expression constructs were co-transformed with the Gin20TALE+0 reporter construct, and almost all colonies were white indicating that recombination occurred and was efficient (Table 17). Thus, for the N-TALER chimeras comprising either the HinB or HinC invertase catalytic domain, both were shown to be functional when tested with the Gin20TALE+0 reporter construct.

Alternatively, it is postulated that the catalytic domain of another class of recombinases, those of the N-terminal DNA-binding class of transposases, can be used to construct TALER chimeras (Smith and Thorpe, 2002). Developing TALERs with a catalytic domain derived from this class of transposases may have particular application to deletion or insertion of DNA in the target chromosome. Also, tyrosine recombinases, such as Cre and FLP, represent another class of recombinases that can be used in a TALER chimera.

The utility of generating a library of TALER chimeras with differing recombinase catalytic domains is to expand the toolkit of TALER components, especially to develop sets of non-interacting TALERs. The resulting TALERs could be desirable because they may have different preferences for the core sequence, thereby overcoming any issues with residual sequence preference in the permissive recombinase catalytic domains. Examples of permissive recombinases can be found in Proudfoot et al., 2011; Gersbach et al., 2010; and Gordley et al., 2007. It is possible that some of the recombinases may have other advantages such as increased recombination efficiency compared to the Gin variants. Also, TALERs can be made with different recombinase domains that do not interact with each other (Gordley et al., 2007; Gaj et al., 2011) and therefore, could be used in combination to direct recombination to multiple sites.

Varying TALER Central Sequence Length

Previous reports on studies with zinc finger recombinase fusion proteins suggested that the length of the recombinase core target site sequence is critical for successful recombination. In these studies, changing the length of the recombinase core target site sequence by even a few by resulted in dramatically reduced recombination frequency (Gordley et al., 2007; Akopian et al., 2003). In contrast to these published reports, the data presented herein with TALERs, there is a wide range in the length of the TALER recombination core sequence where recombination was efficient (Table 6). When a recombinase that has relaxed specificity (a pTALER with a permissive recombinase, GinL7C7-EE2) is used, the size range of the core can be longer when compared to a TALER constructed with a recombinase domain with a restricted specificity (sTALER). The data with the novel TALER chimeras described herein suggest that the spacer length (i.e., length of the TALER recombination core)

TABLE 16

Hin invertase N-TALER chimeras.

| TALER variant | TALE N-terminal site | Linker | Invertase | Nucleotide SEQ ID NO: | Protein SEQ ID NO: |
|---|---|---|---|---|---|
| HinB-N-TALER IV-1 | IV | TVDRSSDPTSQTS | HinB | 179 | 180 |
| HinC-N-TALER IV-1 | IV | TVDRSSDPTSQTS | HinC | 181 | 182 |

TABLE 17

Comparison of
Hinb N-TALER and Hinc N-TALER-mediated recombination efficiency.

| N-TALER variant | Reporter | TALER central sequence length (bp) | Score |
|---|---|---|---|
| HinB-N-TALER IV-1 | Gin20TALE+0 | 20 | 1 |
| HinC-N-TALER IV-1 | Gin20TALE+0 | 20 | 1 | requirement is predicted to vary based on the length and flexibility of the TALER linker, and on the specificity or permissiveness of the recombinase catalytic domain within the TALER chimera. To define the optimal spacer size or sizes for a given TALER chimera, a library of TALER reporter constructs with varying lengths of the TALER central sequence will be tested in pair-wise analysis with each of a library of TALER chimeras.

The results from testing TALER reporter constructs Gin16TALE and Gin14TALE, which have shorter recombinase catalytic sites (Table 4) showed that the TALER chimera, pN-TALER Iv-1 efficiently recombines the TALER reporter constructs with the Gin16TALE site (score=1.5), but not the TALER reporter constructs with Gin14TALE site (score=4). These results also showed that the TALER chimera, sN-TALER IV-1 does not recombine the TALER reporter constructs containing either of the shorter sites (score=5) (Table 18).

TABLE 18 pN-TALER IV-1-EE2 efficiently recombines Gin16 sites (score = 1.5-2) but not Gin14 sites (score = 4-4.5); sN-TALER IV-1 does not recombine Gin16 or Gin14 sites (score = 5).

| TALER variant | Reporter | TALER central sequence length (bp) | Score |
|---|---|---|---|
| pN-TALER IV-1-EE2 | Gin16TALE | 16 | 1.5 |
| sN-TALER IV-1 | Gin16TALE | 16 | 5 |
| pN-TALER IV-1-EE2 | Gin14TALE | 14 | 4 |
| sN-TALER IV-1 | Gin14TALE | 14 | 5 | pN-TALER IV-5-EE2, a TALER with a shorter polypeptide linker (6 amino acids), was tested for TALER-mediate recombination efficiency on three N-TALER reporter constructs with varying the recombinase core sequence lengths: 20, 16, and 14 bp. Results show that TALER shorter polypeptide linker sequences do not compensate for shorter TALER central sequences in N-TALER reporter constructs (Table 19).

TABLE 19

Scoring of bacterial transformants assayed for pN-TALER IV-5-EE2-mediated recombination of N-TALER reporter constructs with TALER central sequence lengths of 20, 16, and 14 bp.

| TALER variant | Linker | Reporter | TALER central sequence length (bp) | Score |
|---|---|---|---|---|
| pN-TALER IV-5-EE2 | SSDPTS | Gin20TALE+0 | 20 | 1 |
| pN-TALER IV-5-EE2 | SSDPTS | Gin16TALE | 16 | 3 |
| pN-TALER IV-5-EE2 | SSDPTS | Gin14TALE | 14 | 5 |

Data analysis on the limited recombination activity (score=3.5) of several of the TALERs with very short N-termini indicates even when the TALE protein N-terminus is truncated beyond those locations previously reported to be necessary for DNA-binding, recombination can occur (Table 20). For at least these tested sTALERs, there may be sufficient interaction between the recombinase domain of the TALER and the recombinase core sequence within the TALER reporter construct to initiate or stabilize TALE DNA-binding by the chimeric recombinase at the TALE binding site also within the TALER reporter construct.

TABLE 20

Scoring of bacterial transformants assayed for sTALER-mediated recombination of TALER reporter constructs with TALER central sequence lengths 16 and 14 bp.

| TALER variant | Gin14TALE reporter | Gin 16TALE reporter | Gin 18TALE+0 reporter | Gin 20TALE+0 reporter |
|---|---|---|---|---|
| sTALER I-1 | 5 | 5 | 5 | 5 |
| sTALER I-2 | 5 | 5 | 5 | 5 |
| sTALER I-3 | 5 | 5 | 5 | 5 |
| sTALER IIa-1 | 5 | 5 | 3.5 | 5 |
| sTALER IIb-1 | 5 | 5 | 3.5 | 5 |
| sTALER IIa-2 | 5 | 4.5 | 3.5 | 5 |
| sTALER III-1 | 5 | 5 | 5 | 5 |
| sTALER III-2 | 5 | 5 | 5 | 5 |

It is possible to design and generate numerous other TALER reporter constructs with a diversity of recombinase core sequences which would be target sites for TALER chimeras with alternative recombinase catalytic domains. The TALER recombinase core sequence would likely dictate which recombinase or resolvase catalytic domain is used. It is possible that there would be more tolerance to sequence variations in the TALER recombinase core sequence with a permissive catalytic recombinase domain in the TALER chimera.

All tested sN-TALERs with very long linkers only produced the expected recombination products. This suggests that the site of recombination will not vary for sN-TALERs. For pN-TALERs, recombination at unpredicted sites did not occur when both sites were perfect. However, when one perfect and one imperfect site were used, while only the expected recombination product was observed at the perfect site, recombination at the imperfect site was not always consistent.

It is postulated that TALERs that are able to recombine core sequences of many different lengths (i.e., pTALERs) are likely to recombine at different positions between the two sites resulting in an unequal resolution. The exact position within the two cores that are recombined may vary from one recombination event to another. In contrast, linkers that confer tight spacer length requirements are predicted to more precisely position the recombinase catalytic domains so that the same position within the core is recombined for most or all recombination events.

TALER Heterotetramers

Due to the nature of the TALER design, dimers of the TALER chimeras bind to a single TALER binding site and the functional DNA recombination occurs when two TALER binding sites are resolved in a TALER tetramer (FIG. 4). In the TALER-mediated recombinase assay reported above, the TALER binding sites were identical and there was only a single TALER chimera (homotetramer) mediating the recombination of the TALER reporter constructs. The recombinase catalytic domains are considered responsible for driving tetramer formation. Therefore, TALER chimeras which contain the same recombinase catalytic domain but differing TALER binding domains will function together as a heterotetramer. Currently, testing is being conducted to assay 1, 2, 3, or 4 TALER chimeras co-expressed in the TALER reporter assay to determine the efficiency of heterotetramer TALER-mediated recombination.

To demonstrate heterotetramer TALER-mediated recombination, a two-plasmid assay was developed for an immature corn embryo expression system. For this assay, a donor plasmid and an acceptor plasmid were each designed to contain an N-TALER central sequence which contained a recombinase core sequence flanked by a 5' TALE binding site and a 3' TALE binding site. The 5' TALE binding site and the 3' TALE binding site sequences were different and required two different N-TALERs to mediate recombination between the donor and acceptor plasmids.

For the assays, a series of N-TALER central sequences were designed containing the same Gin H106Y recombinase core sequence (SEQ ID NO:18) flanked by differing pairs of 5' TALE binding sites and 3' TALE binding sites. The N-TALER binding site sequences are listed Table 21 and the series of N-TALER central sequence constructs are listed in Table 22.

TABLE 21

Heterotetramer N-TALER assay binding site SEQ ID NOs.

| N-TALER binding site | SEQ ID NO |
|---|---|
| N-TALER_IV-5_CP4-01 | 291 |
| N-TALER_IV-5_CP4-02 | 292 |
| N-TALER_IV-5_5.1-01 | 293 |
| N-TALER_IV-5_5.1-02 | 294 |
| N-TALER_IV-5_DNAk-03 | 295 |
| N-TALER_IV-5_DNAk-04 | 296 |
| N-TALER_IV-1_BAPS10 | 297 |
| N-TALER_IV-1_BAPS11 | 298 |

TABLE 22

Heterotetramer N-TALER assay chimera and central sequence combinations.

| | | N-TALER central sequences | | |
|---|---|---|---|---|
| N-TALER chimera pair binding site 1 binding site 2 | Name | N-TALER chimera binding site 1 (SEQ ID NO) | Recombination core (SEQ ID NO) | N-TALER chimera binding site 2 (SEQ ID NO) |
| pN-TALER_IV-5_CP4-01 pN-TALER_IV-5_CP4-02 | CP4_0102 | 291 | 18 | 292 |
| pN-TALER_IV-5_5.1-01 pN-TALER_IV-5_5.1-02 | 5.1_0102 | 293 | 18 | 294 |
| pN-TALER_IV-5_DNAk-03 pN-TALER_IV-5_DNAk-04 | DNAk_0304 | 295 | 18 | 296 |
| pN-TALER_IV-1_BAPS10 pN-TALER_IV-1_BAPS11 | BAPS_1011 | 297 | 18 | 298 |
| sN-TALER_IV_1_DNAk-03 sN-TALER_IV_1_DNAK-04 | DNAk_0304 | 295 | 18 | 296 |
| sN-TALER_IV_1_BAPS_10 sN-TALER_IV-1_BAPS_11 | BAPS_1011 | 297 | 18 | 298 |
| pN-TALER_IV-1_5.1-01 pN-TALER_IV-1_5.1-02 | 5.1_0102 | 293 | 18 | 294 |
| H106Y Gin | Gix | | 299 | |
| Cre | LoxP | | 300 | |

Figure 14:
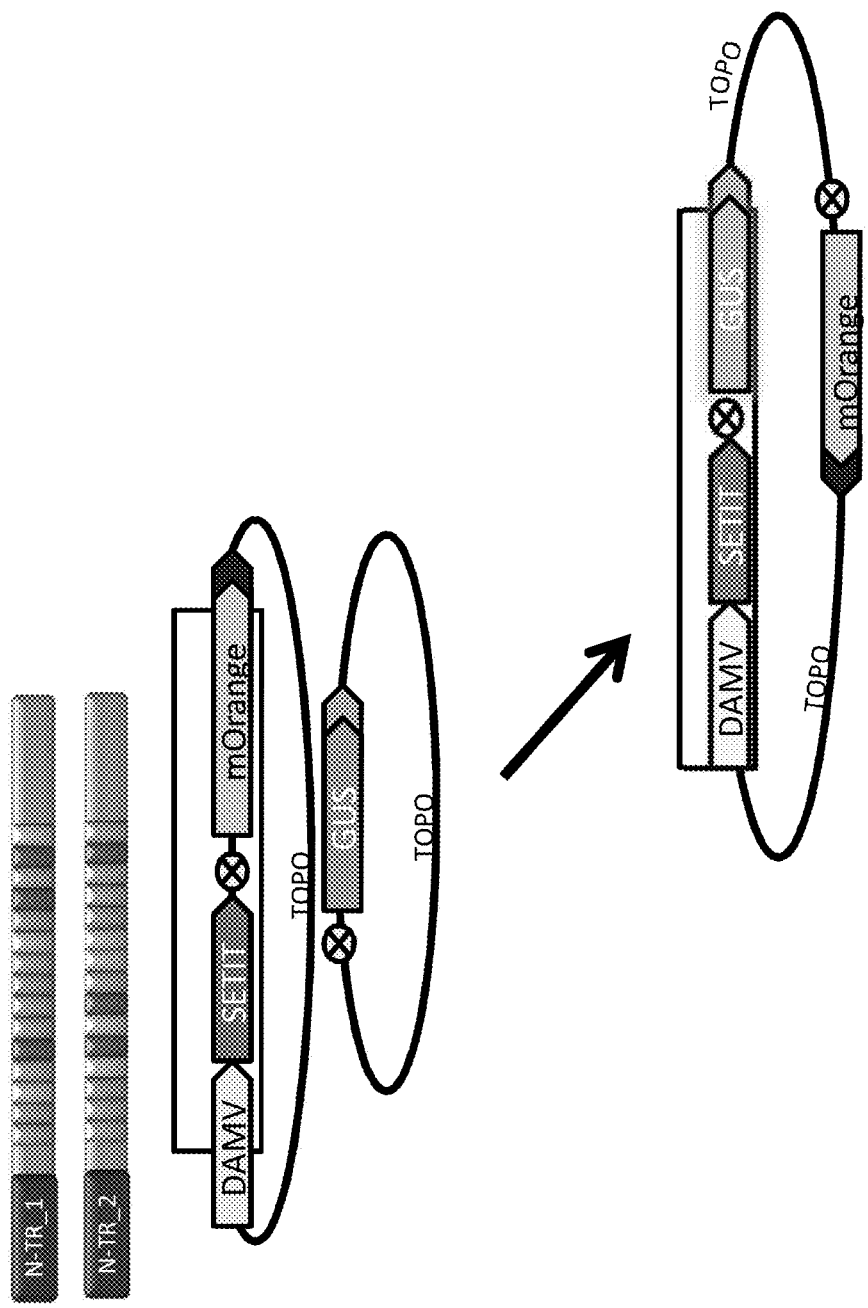
FIG. 14: A schematic representation of two-plasmid, heterotetramer TALER-mediated recombination.

For these assays, the donor plasmid contained one of the N-TALER central sequences to be tested cloned upstream (5') of a GUS reporter gene and, importantly, no promoter to drive GUS expression in the assay system. The acceptor plasmid of these assays contained one of the N-TALER central sequences to be tested cloned between an mOrange reporter gene and a constitutive promoter (DaMV) and intron (SETit) combination used for expression in corn plant cells (see FIG. 14). Both the GUS donor construct and the mOrange construct contained transcription terminators functional in a plant cell.

In addition to the donor and acceptor plasmid constructs, separate N-TALER expression vectors were constructed for expression of N-TALER chimeras in corn plant cells. Three different N-TALER chimera basic structures were designed based on the N-TALER chimeras described in Table 2, namely pN-TALER IV-5-EE2, pN-TALER IV-1-EE2, and sN-TALER IV-1, with each based on a TALE derived from AvrBS3, PtHX01, TALE13, or some hybrid thereof, and all codon optimized for expression in corn. For each of the various N-TALER chimeras, the RVD binding domain was designed to bind to one of the N-TALER binding sites of the N-TALER central sequences to be tested in the two-plasmid assay system. An example of the naming convention used for these N-TALER chimeras, based on the original N-TALER architecture, is that the permissive pN-TALER_IV-5_CP4-01 chimera was designed such that the RVD domain would bind to the N-TALER_IV-5_CP4-01 binding site sequence (SEQ ID NO:291) (see Tables 20.1 and 20.2).

The two-plasmid assay consisted of co-delivery of varying combinations of the N-TALER chimera expression vectors, the donor GUS reporter vector and the acceptor mOrange reporter vector into plant cells. Upon recombination of the donor construct and the acceptor construct, if the GUS is in the correct orientation, the GUS coding sequence is placed downstream of the promoter-intron of the mOrange acceptor plasmid, resulting in detectable GUS activity (see FIG. 14). Note that there are at least three expected outcomes of recombination of this assay system that would not result in GUS expression: N-TALER chimera mediated recombination of two molecules of the acceptor plasmid, N-TALER chimera mediated recombination of two molecules of the donor plasmid, and N-TALER chimera mediated recombination of the donor plasmid and the acceptor plasmid, but with the GUS reporter gene in a 3'- to 5' orientation relative to the promoter-intron of the acceptor plasmid.

For this two-plasmid assay, briefly, the expression vector combinations were mixed and co-coated on 0.6 µM gold particles using standard protocols. These prepared gold particles were then bombarded into 3-day old pre-cultured immature corn embryos. Embryos were maintained in culture for 3-5 days after bombardment and then processed for histochemical staining using X-Gluc (5-bromo-4-chloro-3-indolyl glucuronide) and standard laboratory protocols. Prior to GUS histochemical staining, mOrange fluorescence was scored as an internal marker for transformation efficiency.

In addition to the various heterotetramer test combinations evaluated, numerous negative controls were tested including: (1) an expression vector for one or both of the N-TALER chimeras was omitted, (2) both N-TALER chimera expression vectors of a pair were co-bombarded with only the mOrange acceptor plasmid or only the GUS donor plasmid, (3) there was a mis-match between the N-TALER binding site of the N-TALER central sequence and the N-TALER pair (i.e., N-TALER chimera pair pN-TALER_IV-1_BAPS-10 and pN-TALER_IV-1_BAPS-11 co-bombarded with GUS donor and mOrange acceptor plasmids with the DNAk_0304 N-TALER central sequence), and (4) co-bombardment of the GUS donor and mOrange acceptor plasmids without an N-TALER chimera expression vector. For each of the negative controls, little or no GUS activity was detected.

Positive controls for these assays included co-bombardment of a Cre recombinase expression construct with a donor and an acceptor construct both with a LoxP recombination site, or co-bombardment of a native Gin recombination expression construct with a donor and an acceptor construct both with the native Gix recombination site (see Tables 20.2 and 20.3).

The design of the assays included co-bombardment of an N-TALER chimera pair designed to bind to the two N-TALER binding sites of the donor and acceptor plasmid central sequence, with each of the different combinations of pN-TALER, sN-TALER, and N-TALER binding site tested. Depending on the N-TALER chimera pair and the N-TALER binding site, the resulting GUS activity varied from weak to strong, though the strength of the GUS staining may not be an indication of the efficiency of heterotetramer-mediated TALER recombinase activity (see Table 23). These results indicate that heterotetramer-mediated TALER recombination was successful in this plant assay system.

sites must be flanked by a 5'A and a 3'T, and have a length of 18-44 bp. Furthermore, the core sequences must be recombinable by the recombinase catalytic domain. Using a highly permissive recombinase domain without any sequence preference, then any two sequences can be suitably recombined by TALERs as long as the sequences contain cores flanked by a 5'A and a 3'T with a length of 18-44 bp, and TALEs can be designed that bind the sequences adjacent to the cores. Preferred lengths for the cores are ~20 bp, ~30 bp and ~40 bp. Also, it is contemplated that with the appropriate combination of TALERs (including possibly pTALERs and sTALERs) two different sequences can be the target of TALER-mediated recombination.

Previous studies with a ZFR containing a Tn3 catalytic domain (Proudfoot et al., 2011) have demonstrated that when a permissive domain is not 100% permissive, the range of possible core sequences that can be recombined is expanded when one of the two sequences to be recombined is the preferred sequence. That is, a first recombination core sequence, which is not the preferred site for the recombinase catalytic domain, cannot be recombined with an identical core sequence by the particular recombinase catalytic domain. But, this first recombination core sequence often can be recombined with a second, non-identical core sequence when the second non-identical core sequence is a suitable substrate for the recombinase catalytic domain. (Proudfoot et al., 2011).

C-TALER Experimental Assay Protocol

Testing for recombination was done essentially as described for N-TALER expression constructs and N-TALER reporter constructs (described above). For these experiments, different combinations of C-TALER expression constructs (Table 3) and C-TALER reporter constructs (Table 5)

TABLE 23

Results of heterotetramer two-plasmid assay when the N-TALER chimera matched the N-TALER central sequence of the GUS donor and mOrange acceptor plasmids.

| N-TALER chimera combination | mOrange acceptor | GUS donor | Number of assays | Number of positive GUS assays | GUS scoring |
|---|---|---|---|---|---|
| pIV-5_CP4-01 pIV-5_CP4-02 | CP4_0102 | CP4_0102 | 2 | 1 | weak |
| pIV-5_5.1-01 pIV-5_5.1-02 | 5.1_0102 | 5.1_0102 | 1 | 1 | weak |
| pIV-5_DNAk-03 pIV-5_DNAk-04 | DNAk_0304 | DNAk_0304 | 3 | 3 | medium |
| pIV-1_BAPS10 pIV-1_BAPS11 | BAPS_1011 | BAPS_1011 | 2 | 1 | weak |
| sIV-1_DNAk-03 sIV_1_DNAK-04 | DNAk_0304 | DNAk_0304 | 1 | 1 | weak |
| sIV-1_BAPS_10 sIV-1_BAPS_11 | BAPS_1011 | BAPS_1011 | 1 | 1 | strong |
| pIV-1_5.1-01 pIV-1_5.1-02 | 5.1_0102 | 5.1_0102 | 1 | 1 | medium |
| H106Y Gin | Gix | Gix | 1 | 1 | medium |
| Cre | LoxP | LocP | 4 | 3 | strong |

The utility of heterotetramer TALER-mediated recombination is that any sequence of the correct length that is flanked by TALE binding sites can be recombined by the appropriate combination of TALERs. Specifically, the set of TALERs (a set being 1, or 2 to 4 different TALERs) must have recombinase catalytic domains that are compatible with each other (e.g., if they are all the same domain such as Gin-L7C7-EE2). The TALERs will have TALE binding domains designed to bind the sequences flanking the recombination site core sequences. Since TALE binding requires a site with a 5'T, suitable recombination were co-transformed into E. coli DH5alpha cells. Each of the C-TALER expression plasmids was co-transformed into bacteria with one of three separate C-TALER reporter constructs.

Results from C-TALER expression and C-TALER transformation are shown in Table 24. Each plate had ~200-300 colonies. In this table, the numbers assigned to sectored colonies is the same scoring system used to describe the results for N-TALERs (i.e., Table 6). The colonies grown from C-TALER expression and C-TALER reporter co-transformation resulted in colonies which were entirely blue, light blue, sectored, white with a blue center (scored as sectored 1.5 to 2), or white. When colonies were light blue but not sectored, re-streaking resulted in colonies which remained blue. The colony phenotype of light blue coloring was reproducible when the same C-TALER expression construct and C-TALER reporter construct pairs were transformed. Often it was difficult to distinguish light blue colonies from colonies that were sectored or had blue centers. For these experiments, the colonies were re-streaked and the colony phenotype of the resulting colonies was determined. For colonies which initially showed either a sectored or blue center, re-streaking resulted in the colonies on the re-streaked plates which were predominantly white. Results of colony PCR and sequencing of these re-streaked white colonies indicated that there was recombination of the C-TALER reporter. These results suggest that the "blue center" phenotype is a variation of a sectored phenotype. It is postulated that the variation in the patterns of colony color are indicative of a continuum of C-TALER activity. Specifically, effective C-TALER recombinase expression with C-TALER reporter pairs produce white colonies, less active C-TALER recombinases produce a small blue center, even less active C-TALER recombinases produce the sectoring phenotype.

As expected, the control transformations (no C-TALER expression plasmid) showed no recombination of the C-TALER reporter construct, as evidenced by blue colonies. Based on the overall colony color from co-transformation of each individual C-TALER expression construct with one of three C-TALER reporter constructs (R61, R65 or R67), the appearance of sectored and or white colonies indicates that C-TALER-mediated recombination was successful for particular C-TALER chimera expression constructs and C-TALER reporter constructs (Table 24).

Based on colony color, the reporter R61, which has no nucleotides as a spacer between the recombinase central domain and the flanking two TALE DNA-binding sites, demonstrated the least efficiency of recombination. With this R61 reporter construct, the C-TALER chimeras with the mlh DNA-contact domain or the synthetic DNA-contact domain resulted in predominately blue colonies, suggesting no C-TALER-mediated efficient recombination of this reporter (Table 24).

In contrast, based on colony color, the reporter R65, which has 6 nucleotides as spacers on each side of the recombinase core sequence (Table 5), had blue colonies with the two C-TALER chimeras A1-1 and A1-2. This indicated that these two C-TALER chimeras likely did not facilitate recombination with the C-TALER reporter R65.

For the reporter R67, which has 10 nucleotides as spacers on each side of the recombinase core sequence (Table 5), there were no C-TALER chimeras which resulted in only blue colonies. This indicated that all C-TALER chimeras tested were able to facilitate recombination with the C-TALER reporter R67.

Results obtained using the C-TALER chimeric proteins suggest that each of the six variants of the C-TALER chimeras with an attached ruvA domain (A2-1, B2-1, C2-1, A2-2, B2-2, and C2-2) resulted in recombination for each of three separate C-TALER reporter constructs (R61, R65, and R67). However, the C-TALER chimera B2-2 was the least efficient, with up to 50% of the colonies showing blue color, indicating little recombination. The C-TALER chimeras with the DNA-contact domain comprised of the short basic polypeptide (A1-1, B1-1, C1-1, A1-2, B1-2, and C1-2) resulted in recombination for the two reporters with longer spacers (R65 and R67), but not for the reporter with no spacers (R61).

TABLE 24

Scoring of bacterial transformants assayed for C-TALER-mediated recombination of reporter constructs.

| C-TALER chimera | R61 Gin20+inverted TALE13+0 | R65 Gin20+Inverted TALE13+6 | R67 Gin20+Inverted TALE13+10 |
|---|---|---|---|
| G3-1 | All blue | All blue (3 white colonies) | All blue only 3 colonies light blue~1 |
| G2-1 | All blue with white ring | All light blue* | All light blue* |
| G1-1 | All Light blue* | All blue (1 white colony) | All light blue* |
| G3-2 | All light blue* (restreak: light blue*) | All light blue* (restreak: blue) | All white ring (restreak: 1 streak light blue, 1 streak blue) |
| G2-2 | All light blue* (restreak: light blue*) | 3 white colonies, rest light blue* (restreak: blue) | All white ring (restreak: 1 streak light blue, 1 streak blue) |
| G1-2 | All light blue* (restreak: light blue*) | All white ring (restreak: 2 streak white, 1 streak blue) | All white ring (restreak: 1 streak light blue, 1 streak blue) |
| A3-1 | ~250 colonies full blue, ~80 colonies with white outer ring (restreak: light blue*) | ~200 colonies with white outer ring (restreak: light blue*) | All light blue* (37 very light blue) (restreak: 2 streak light blue, 1 streak white) |
| B3-1 | All blue | All white ring (restreak: streak white) | All white ring (restreak: streak white) |
| C3-1 | All blue | All light blue* | All light blue* |
| A3-2 | All blue | Most blue; only 21 white ring (restreak: 2 streak light blue, 1 streak white) | Mostly blue ~4 (71 with blue center sectoring) |
| B3-2 | All blue | All light blue*(restreak light blue*) | All light blue* |
| C3-2 | All blue | All light blue* | All light blue* |
| A2-1 | All blue | All white (4 or 5 sectored, score 2) | All white (only 8 sectored, score 2) |
| B2-1 | All sectored, score 4 | All white only 18 with blue center ~2 | All white (only 11 with white ring) |
| C2-1 | All sectored, score 3 | All white | All white (one blue) |

TABLE 24-continued

Scoring of bacterial transformants assayed for C-TALER-mediated recombination of reporter constructs.

| C-TALER chimera | C-TALER reporter constructs | | |
|---|---|---|---|
| | R61 Gin20+inverted TALE13+0 | R65 Gin20+Inverted TALE13+6 | R67 Gin20+Inverted TALE13+10 |
| A2-2 | All blue | All white | All white (only 15 colonies sectored, score 1.5) |
| B2-2 | Mixed population more sectored, score 4, and some blue (10:3) | Mixed colonies, some full white and some sectored (10:3) | Mixed population of colonies half white and half sectored |
| C2-2 | All sectored, score 3 | All white | All white |
| A1-1 | All blue | All blue | All sectored, score 4 |
| B1-1 | All blue | All sectored, score 3 | All sectored, score 3 |
| C1-1 | All blue | ~100 white ~100 sectored, score 1, (10 blue) | ~100 white and ~100 sectored, score 1, (7 blue) |
| A1-2 | All blue | All blue | All sectored, score 4 |
| B1-2 | All blue | All sectored, score 3 | All sectored, score 4 |
| C1-2 | All blue | All sectored, score 2.5 | All sectored, score 4 |

To confirm recombination, colony PCR and sequence analysis was performed on colonies from several of the transformation pairs. PCR primers were designed to flank the two C-TALER central sequences such that the product would include both C-TALER central sequences and the LacZalpha gene of the reporter construct which was not recombined. Likewise, the PCR primers would amplify the single resulting C-TALER central sequence which is resolved with C-TALER-mediated recombination. The PCR product was treated with ExoSap and sequenced. Table 25 summarizes results obtained from representative PCR colony screen and sequencing of the PCR product to determine if the recombination occurred as predicted. If there were multiple colonies for a given C-TALER chimera and C-TALER reporter tested, then that is indicated in the column as the number of repeats. In summary, both white and sectored colonies were determined to have a correctly recombined target site. As seen in Table 25, most recombinations were perfect, meaning that the predicted product was produced and there was no evidence (e.g., double peaks after the recombination site, as seen on the sequencing chromatogram) that other recombination products were produced. If examination of the trace files suggested that recombination was other than expected, the reaction was scored as "complex."

TABLE 25

Colony PCR and sequence analysis summary of bacterial transformants assayed for C-TALER-mediated recombination of reporter constructs.

| Reporter/Chimera | Colony color | Confirmation of recombined sequence? | Number of colonies tested |
|---|---|---|---|
| R61/G3-2 | light blue | yes | 1 |
| R61/G1-2 | light blue | complex | 1 |
| R61/A3-1 | light blue | no | 1 |
| R61/B3-1 | blue | yes | 1 |
| R61/A2-1 | blue | no | 2 |
| R61/A2-2 | blue | no | 1 |
| R61/B2-1 | sectored | yes | 2 |
| R61/B2-2 | sectored | yes | 1 |
| R61/C2-1 | sectored | yes | 1 |
| R61/C2-2 | sectored | yes | 2 |
| R65/G1-2 | white | yes | 2 |
| R65/G1-2 | blue | complex | 1 |
| R65/A3-1 | light blue | yes | 1 |
| R65/A3-2 | white | no | 1 |
| R65/B3-1 | white | yes | 3 |
| R65/B3-2 | white | yes | 1 |
| R65/B3-2 | light blue | yes | 1 |
| R65/A2-1 | white | yes | 6 |
| R65/A2-2 | white | yes | 7 |
| R65/B2-1 | white | yes | 6 |
| R65/B2-2 | white | yes | 2 |
| R65/B2-2 | blue | no | 1 |
| R65/C2-1 | white | yes | 3 |
| R65/C2-2 | white | yes | 4 |
| R65/B1-1 | sectored | yes | 3 |
| R65/B1-2 | sectored | yes | 3 |
| R65/C1-2 | sectored | yes | 2 |
| R65/C1-1 | sectored | yes | 3 |
| R65/C1-1 | white | yes | 1 |
| R67/G3-2 | light blue | yes | 1 |
| R67/G3-2 | blue | yes | 1 |
| R67/G2-2 | blue | yes | 1 |
| R67/G2-2 | white | yes | 1 |
| R67/G1-2 | blue | yes | 1 |
| R67/G1-2 | white | yes | 1 |
| R67/A3-1 | light blue | no | 1 |
| R67/A3-2 | white | yes | 1 |
| R67/B3-1 | white | yes | 1 |
| R67/A2-1 | white | yes | 6 |
| R67/A2-1 | blue | yes | 1 |
| R67/A2-2 | white | yes | 6 |
| R67/A2-2 | blue | yes | 1 |
| R67/B2-1 | white | yes | 6 |
| R67/B2-1 | blue | no | 1 |
| R67/B2-2 | white | yes | 2 |
| R67/B2-2 | blue center | no | 2 |
| R67/C2-1 | white | yes | 4 |
| R67/C2-2 | white | yes | 1 |
| R67/A1-1 | sectored | yes | 4 |
| R67/A1-2 | white | yes | 4 |
| R67/A1-2 | sectored | yes | 2 |
| R67/B1-1 | sectored | yes | 2 |
| R67/B1-2 | sectored | yes | 4 |
| R67/C1-2 | sectored | yes | 4 |
| R67/C1-1 | white | yes | 4 |

To examine additional combinations of C-TALER reporter constructs and C-TALER chimeras, a pool of C-TA- LER reporter constructs (R60, R61, R62, R63, R64, R65, R66, R67, R68, R69, R70) plus or minus the N-TALER reporter (R71) was co-transformed with the different C-TALER chimera expression constructs (Table 26). The TALER reporter constructs, R60 to R71, were combined in equal proportion in the pool for transformation. As per standard protocols, bacteria were co-transformed with the C-TALER chimera expression constructs and the pool (R60 to R70 or R60 to R71), plated on selection media containing kanamycin, chloramphenicol, and x-gal. Construct 13 comprised only a TALE DNA-binding domain and no recombinase domain. It was assumed that due to the limiting concentration of TALER reporter constructs in the pool, and the C-TALER chimera expression constructs, that single colonies contain one of the different reporters and the C-TALER chimera being tested, and that all combinations of C-TALER reporter construct and C-TALER expression construct combinations were represented in the colonies. All C-TALER reporter constructs (R60 through R71) were transformed individually, without a C-TALER chimera, and no recombination, as evidenced by blue colonies and never white or sectored colonies.

For every combination tested, transformed bacteria were plated onto three plates. The ratio of blue colonies to white colonies to sectored colonies was the same on all three plates of a particular C-TALER chimera expression construct by C-TALER pool tested. Only one of the three plates representing each pool was scored for colony color. For particular pools where all of the colonies were blue, it was concluded that none of recombination sites in any of the 11 different C-TALER reporter constructs in the pool was recombined by the particular C-TALER chimera.

For particular pools where some white colonies were produced, it was concluded that one or more of the C-TALER reporter constructs in the pool provided a TALER central sequence that was recombined by the particular C-TALER chimera (Table 26). For each of the C-TALER chimeras represented by the four different DNA-contact domains and the C-TALER chimera without a DNA-contact domain, white or sectored or blue center colonies were observed, suggesting that there was at least one C-TALER reporter in the pool of C-TALER reporter constructs which was recombined by the different C-TALER chimeras tested (Table 26). Co-transformation with the pC-TALER chimera containing the ruvA DNA-contact domain produced mostly blue colonies with an abnormal colony phenotype.

TABLE 26

C-TALER chimera results of co-transformation with pooled C-TALER reporter constructs.

| C-TALER chimera expression construct | Pool | Results (plated on kan + chl + X-gal) |
| --- | --- | --- |
| none | R60-R71 | ~300 colonies all blue |
| Gin | | |
| G3-1 | R60-R71 | ~250 colonies all blue |
| G2-1 | R60-R71 | ~250 colonies all blue |
| G1-1 | R60-R71 | ~300 colonies full blue and 20 white with blue center |
| G3-2 | R60-R71 | ~200 colonies blue, 10 light blue |
| G2-2 | R60-R71 | ~200 colonies blue, 10 light blue |
| G1-2 | R60-R71 | ~200 colonies blue, 5 light blue |
| mlh | | |
| A3-1 | R60-R71 | ~150 colonies blue, 50 white |
| B3-1 | R60-R71 | ~240 blue, 10 with blue ring |
| C3-1 | R60-R71 | ~150 blue, 20 light blue |

TABLE 26-continued

C-TALER chimera results of co-transformation with pooled C-TALER reporter constructs.

| C-TALER chimera expression construct | Pool | Results (plated on kan + chl + X-gal) |
| --- | --- | --- |
| A3-2 | R60-R71 | ~220 colonies blue, 30 white, 2 sectored |
| B3-2 | R60-R71 | ~300 colonies all blue |
| C3-2 | R60-R71 | ~300 colonies all blue |
| ruvA | | |
| B2-1 | R60-R71 | ~300 colonies, 50 blue, 200 sectored, 50 white |
| C2-1 | R60-R71 | total ~350 colonies, ~100 blue, 100 white, 100 sectored |
| B2-2 | R60-R71 | Mixed colonies ~150 blue and 150 white |
| pA2-1 | R60-R70 | blue, white, sectored (These colonies all look sick) |
| pA2-2 | R60-R70 | blue, white, sectored (These colonies all look sick) |
| pB2-1 | R60-R70 | blue, white, sectored (These colonies all look sick) |
| pB2-2 | R60-R70 | blue, white, sectored (These colonies all look sick) |
| pC2-1 | R60-R70 | blue, white, sectored (These colonies all look sick) |
| pC2-2 | R60-R70 | blue, white, sectored (These colonies all look sick) |
| basic peptide | | |
| A1-1 | R60-R71 | 250 blue, 50 white, 50 sectored |
| B1-1 | R60-R71 | 100 blue, white 20, sectored 80 |
| C1-1 | R60-R71 | 150 blue, 25 white, sectored 25 |
| B1-2 | R60-R71 | ~250 All blue, 3 blue with white ring outside |
| C1-2 | R60-R71 | ~200 colonies, 10 white, 110 blue with white ring, 30 sectored |
| none | | |
| A4-1 | R60-R70 | blue, white, sectored (sectored score 4) |
| B4-1 | R60-R70 | ~250 colonies on the plate mostly white with a few sectored (score 1.5) |
| C4-1 | R60-R70 | ~250 colonies on the plate white, blue and sectored (score 4) |
| A4-2 | R60-R70 | blue, white, sectored (sectored score 4) |
| B4-2 | R60-R70 | ~250 colonies on the plate white, sectored (score 4), very few blue |
| C4-2 | R60-R70 | ~250 colonies on the plate mostly blue, a few white and couple of them sectored (score 3) |
| pA4-1 | R60-R70 | mostly blue, 2 white, couple of them sectored (sectored score 3) |
| pA4-2 | R60-R70 | mostly white, some sectored (sectored score 3), couple of them blue |

As can be seen from Table 26, the C-TALER expression constructs without a DNA contacting domain (A4-1, B4-1, C4-1, A4-2, B4-2, C4-2, and pA4-2) when co-transformed with a pool of C-TALER expression constructs (R60-R70) showed colonies that were white, sectored, and blue. The white and sectored colonies suggest that these C-TALER expression constructs are sufficient to cause recombination. To test which C-TALER reporter constructs were recombined by these C-TALER expression constructs, these were co-transformed with each individual reporter construct. The results from these experiments are shown in Table 27. The presence of plates with all white colonies for certain C-TALER/reporter combinations indicates that the DNA contacting domain is not required for C-TALER-mediated recombination. For these experiments, there were a range of 200-250 colonies per plate.

TABLE 27

Results of C-TALER chimeras individually co-transformed with C-TALER reporter constructs.

| C-TALER chimera expression construct | Reporter construct | Results (plated on kan + chl + X-gal) |
|---|---|---|
| A4-1 | R60 | All blue |
| A4-1 | R61 | All blue |
| A4-1 | R62 | All blue |
| A4-1 | R63 | All blue |
| A4-1 | R64 | One blue, rest all white |
| A4-1 | R65 | 3 blue, rest all white |
| A4-1 | R66 | 2 blue, rest all white |
| A4-1 | R67 | All white |
| A4-1 | R68 | All white |
| A4-1 | R69 | One blue; rest all white |
| A4-2 | R60 | One blue; rest all white |
| A4-2 | R61 | All blue |
| A4-2 | R62 | All blue |
| A4-2 | R63 | All blue |
| A4-2 | R64 | All white |
| A4-2 | R65 | All white |
| A4-2 | R66 | All white |
| A4-2 | R67 | All white |
| A4-2 | R68 | All white |
| A4-2 | R69 | All white |
| pA4-2 | R60 | All blue center |
| pA4-2 | R61 | All blue center |
| pA4-2 | R62 | All blue center |
| pA4-2 | R63 | All blue center |
| pA4-2 | R64 | 5 white; rest all sectored (score 3.0) |
| pA4-2 | R65 | Some white; some sectored (score 2.0) |
| pA4-2 | R66 | Mostly white; few sectored (score 2.0) |
| pA4-2 | R67 | Mostly sectored (score 3.0), a couple of colonies white |
| pA4-2 | R68 | All blue center |
| pA4-2 | R69 | Mostly center, a couple of tiny white |

To determine which reporters were recombined, selected colonies from some of the plates were subjected to two separate colony PCR reactions and the PCR products were sequenced. The two colony PCR reactions were designed with one set of PCR primers for the C-TALER reporters, and the second CPR reaction was with a second set of PCR primers for detecting the C-TALER chimera expression construct. For colonies which were either sectored, or had a blue center, only the white section of the colony was analyzed by colony PCR. In all cases, the C-TALER variants were confirmed to be those expected (Table 28). Unless otherwise indicated, the sequence of the C-TALER reporter was as expected.

For the colonies transformed with the C-TALER chimeras comprising the Gin C-terminal DNA-contact domain (G1-1, G3-2, G2-2, and G1-2) that were analyzed, the C-TALER reporters found by PCR colony screen and sequencing were R61, R62, R63, and R67. With the two colonies which contained the reporter R71, there was no recombination, as expected. For one colony from the C-TALER chimera G3-2, the reporter R68 was not recombined. For one colony from the C-TALER chimera G2-2, the reporter could not be determined due to poor sequencing reads. For one colony from the C-TALER chimera G1-2, the reporter could not be determined due to apparent inverted orientation of one (or both) of the TALE binding sites in the C-TALER target sequence.

For the colonies transformed with the C-TALER chimera comprising the mlh C-terminal DNA-contact domain (C3-1) that were analyzed, of the C-TALER reporters that were found by PCR colony screen and sequencing, R61, R64, and R68, none were recombined.

For the colonies transformed with the C-TALER chimera comprising the ruvA C-terminal DNA-contact domain (C2-1) that were analyzed, the C-TALER reporters that were found by PCR colony screen and sequencing were R60, R65, R66, R68 and R69. For one colony from the C-TALER chimera C2-1, the reporter R68 was not recombined For the colonies transformed with the C-TALER chimeras comprising the basic peptide C-terminal DNA-contact domain (A1-1, B1-1, C1-1, B1-2 and C1-2) that were analyzed, the C-TALER reporters found by PCR colony screen and sequencing were R65, R66, R67, R68, R69, and R70. All colonies analyzed contained a C-TALER reporter confirmed by sequence to be correctly recombined. For the C-TALER chimera C1-1, of the 32 colonies analyzed, only 3 reporters, R65, R66 and R67, were represented suggesting that this C-TALER chimera has a preferred spacer size of 6, 8 or 10 nucleotides. This is consistent with the data presented in Table 27, indicating that only blue colonies are produced when C-TALER chimera, C1-1, is transformed with the C-TALER reporter R61, and most of the colonies are white when the same C-TALER chimera, C1-1, is transformed with the C-TALER reporter R65 or C-TALER reporter R67.

TABLE 28

Sequencing analysis of individual colonies from co-transformation of pooled C-TALER reporter and chimera expression constructs.

| Chimera | Colony color | Reporter | Number of colonies tested |
|---|---|---|---|
| Gin | | | |
| G1-1 | ~300 colonies full blue and 20 white with blue center | | |
| | blue center | R63 | 1 |
| | blue center | R62 | 1 |
| | white | R62 | 2 |
| | white | R63 | 3 |
| | blue | R71† | 1 |
| G3-2 | ~200 colonies blue, 10 light blue | | |
| | blue center | R61 | 1 |
| | blue center | R63 | 1 |
| | blue center | R68† | 1 |
| | blue center | R71† | 1 |
| G2-2 | ~200 colonies blue, 10 light blue | | |
| | blue center | R62 | 1 |
| | blue center | R63 | 1 |
| | blue center | R67 | 1 |
| | blue center | Poor reads | 1 |
| G1-2 | ~200 colonies blue, 5 light blue | | |
| | blue center | R61 | 2 |
| | blue center | R62 | 1 |
| | blue center | * | 1 |
| mlh | | | |
| C3-1 | ~150 blue, 20 light blue | | |
| | blue center | R61† | 1 |
| | blue center | R64† | 1 |
| | blue center | R68† | 2 |
| ruvA | | | |
| C2-1 | total ~350 colonies, ~100 blue, 100 white, 100 sectored | | |
| | sectored | R60 | 1 |
| | white | R65 | 3 |
| | white | R66 | 1 |
| | white | R68 | 1 |
| | white | R68† | 1 |
| | white | R69 | 1 |
| basic peptide | | | |
| A1-1 | 250 blue, 50 white, 50 sectored | | |
| | blue center | R66 | 2 |
| | white | R66 | 1 |
| | white | R69 | 2 |
| | white | R70 | 3 |

TABLE 28-continued

Sequencing analysis of individual colonies from co-transformation of pooled C-TALER reporter and chimera expression constructs.

| Chimera | Colony color | Reporter | Number of colonies tested |
|---------|--------------|----------|---------------------------|
| B1-1 | 100 blue, white 20, sectored 80 | | |
| | blue center | R65 | 1 |
| | white | R65 | 2 |
| | white | R66 | 2 |
| | blue center | R67 | 2 |
| | white | R68 | 1 |
| C1-1 | 150 blue, 25 white, sectored 25 | | |
| | blue center | R65 | 2 |
| | white | R65 | 14 |
| | white | R66 | 6 |
| | white | R67 | 10 |
| B1-2 | ~250 All blue, 3 blue with white ring outside | | |
| | white | R65 | 2 |
| | blue center | R65 | 1 |
| | white | R67 | 1 |
| C1-2 | ~200 colonies, 10 white, 110 blue with white ring, 30 sectored | | |
| | white | R65 | 4 |

†C-TALER reporter was not recombined.
* Clean reads that become two peaks at TALE binding site (possible opposite orientation of TALE binding sites).

Example 5

Gene-Targeting

It is contemplated that a utility for the novel TALER technology described herein would be for gene insertion and gene removal in a genome. A particular genome envisioned is a plant or animal genome.

Testing will be done using gene insertion in plant protoplasts. In one example, a CP4 expressing corn line is available for which starting material can be obtained. A TALER will be generated which will target a pair of sites present in the CP4 cassette of this corn line. Then, protoplasts from this line will be co-transformed with a construct containing a promoterless GFP CDS plus terminator, and the TALER chimera expression cassettes. If TALER-mediated recombination is successful, the GFP CDS will replace the CP4 CDS and the GFP CDS will be transcribed from the promoter which drives expression of the CP4 CDS before recombination exchanged the two CDSs. Protoplasts can be examined for GFP expression (transcription and translation) using the operetta system (Perkin Elmer, Waltham, Mass.).

An alternative means to test for TALER-mediated gene insertion is to target genes that are highly expressed in protoplasts and targeting either or a GFP CDS or an mOrange CDS by insertion into these sites, which should result in the activation of the inserted CDS.

To accomplish gene-targeting in a genome using, as an example, corn etiolated leaf protoplasts, the following will be done:
1. Choose a site with a TALER central sequence of the correct size (e.g., 18-44 bp) with a preceding 5'A and a following 3'T.
2. Create a plant TALER expression cassette which is (a) codon optimized for corn and (b) contains expression elements for plant expression (i.e., (1) e35S:DnaK intron:TALER CDS including NLS:NosT, or (2) DaMV: I-Setit.Act4 intron:TALER CDS including NLS:T-Os.LTP).
3. Put correct TALE repeats into the plant TALER expression cassette.
4. Create a donor construct that contains the Gin 20 bp core flanked by the TALE binding sites. The donor construct also contains a GFP CDS (that lacks a promoter) that will be activated upon recombination.
5. Co-transform plant cells with the TALER encoding cassettes and the donor construct then extract DNA from the cells and use PCR to determine if the plasmid has inserted at the desired location.

To accomplish stable targeted gene integration in a plant genome using corn immature embryos and biolistics, the following will be done:
1. Choose a site in the genome with a TALER central sequence of the correct size (e.g., 18-44 bp) with a preceding 5'A and a following 3'T.
2. Create a plant TALER expression cassette which is (a) codon optimized for corn and (b) contains expression elements for plant expression (i.e., (1) e35S:DnaK intron:TALER CDS including NLS:NosT, or (2) DaMV: I-Setit.Act4 intron:TALER CDS including NLS:T-Os.LTP).
3. Put correct TALE repeats into the plant TALER expression cassette.
4. Create a donor construct that contains the Gin 20 bp core flanked by the TALE binding sites and a plant selectable marker. In the first set of test experiments, the donor construct also contains a GFP CDS (that lacks a promoter) that will be activated upon recombination.
5. Co-transform plant cells with the TALER encoding cassettes and the donor construct and select for stable transformants.
6. Evaluate the transformants to determine if the plasmid DNA has integrated at the desired location. In the first set of experiments, activation of GFP will occur upon integration into the desired location and in the desired orientation. Evaluation of each event for targeting can also be accomplished by PCR screening, Southerns, and other gene-targeting assays.

Gene Removal In Vivo or In Planta

Like the experiments planned for genome targeted gene insertion, a set of TALERs will be designed to remove a DNA segment from a genome. This set of TALER expression constructs will be transformed into protoplasts, as previously described. PCR will be done on DNA extracted from the transformed protoplasts to detect TALER-mediated DNA deletion.

Example 6

TALER-Mediated Targeted Integration into Genomes

A utility of the novel TALER technology described herein is to integrate DNA into a genome. Several different approaches, detailed below, are contemplated for this mechanism of TALER-mediated DNA integration.

I. Circular DNA Integrated into a Genome.

TALER-mediated recombination between a site on the circular DNA molecule and the target site in the genome will place the circular DNA at the desired genomic location. In order to produce quality events that lack undesired sequences such as bacterial selectable marker, origins of replication or plant selectable markers, the undesired portion will be flanked with a separate, distinct, pair recombination sites (e.g., lox sites). After recovery of a targeted event, expression of a second recombinase (e.g., by crossing to a Cre expressing line) will remove the undesired sequence.

II. Linear DNA Integrated Via a Circularization Step.

In a cell, a molecule of linear DNA is circularized by the action of a pair of TALERs. The resulting circular DNA is then integrated into a targeted site of the genome by the same TALER-mediated recombination that generated the circular DNA from the linear DNA molecule.

III. Linear or Circular DNA Integration Using Two Different Recombination Sites.

Similar to the mechanism described for genomic integration of circularized linear DNA, separate and unique TALER molecules for generating circular DNA from linear DNA can be used after TALER-mediated linear DNA circularization to integrate the newly-circularized DNA into the target host genome.

IV. First Integrate Donor DNA into Genome then Move to Desired Location Using TALERs.

The donor DNA would be introduced into a plant using conventional transformation methods. Afterward, TALER-mediated recombination would be delivered (e.g., by crossing to a TALER expressing plant, or by activating transcription via a regulated promoter) and the TALER molecules would integrate the donor DNA into the targeted genomic location.

This process may involve transformation to deliver a sequence of interest flanked by compatible recombination sites. Next, in a stepwise fashion, expression of one or a combination of TALERs first causes recombination of the two flanking sites excising the desired sequence to form an extrachromosomal circular DNA with a single recombination site. This recombination site would then be recombined with the desired genomic location to insert the desired sequence.

Alternatively, the desired sequence would be flanked by two different, mutually incompatible sites. In this case, two sets of incompatible TALERs would be expressed that cause recombination with two adjacent sequences in the genome to move the desired sequence from the initial insertion site to the subsequent, desired site.

V. Deliver Donor DNA on a Plant Viral Replicon.

A plant viral replicon will make many copies of dsDNA comprising the donor DNA sequence. A TALER could then mediate recombination of the plant viral replicon, resulting in a circular copy of the donor DNA sequence "looping out." This circular copy of the donor DNA sequence could then be a substrate for TALER-mediated integration at the desired genomic site. For conditions where two different TALER recombinases are used, the donor DNA sequence can be "exchanged" into the genome. The TALER recombinases in this case could be delivered transiently concurrent with the plant viral replicon, on a separate DNA molecule, or even integrated into the plant genome. In the latter case, recombinase plant lines, with promoters that can be regulated via environmental conditions or exogenous chemicals, can be produced and retransformed with the viral replicon containing recombination sites and donor DNA.

Example 7

TALER-Mediated Recombination Between Recombinase DNA-Recombination Target-Sequences with Non-Identical Recombinase Core Sequences In publications describing the generation and selection of the serine recombinase GinL7C7-EE2 variant and other permissive Gin variants (Gersbach, 2010; Gordley, 2007), the serine recombinase variants were first selected for their ability to recombine a Gin site with a Tn3 site (TCCAAAACCATGGTTTACAG×TGATAATTTATAAT-ATTTCG; SEQ ID NO:18×SEQ ID NO:183). This generated the serine recombinase GinL7C7 variant. In a second effort, the recombinase GinL7C7 variant was further mutated and selected for recombination of two GinE sites (GTGAGCACCATGGAGCTGGC×GTGAGCACCATG-GAGCTGGC; SEQ ID NO:184×SEQ ID NO:184) producing the serine recombinase, GinL7C7-EE2. The authors did not report the extent of sequence variation that could be successfully recombined with a "perfect" Gin site by the mutated serine recombinase GinL7C7-EE2 catalytic domain. Furthermore, all of the sequences reported in these publications to have been tested had an "AT" di-nucleotide pair at the center of the sequences to be recombined. Other serine recombinases, whether natural or evolved, will have sequence requirements for the respective recombinase sites. For each of these separate serine recombinases, we define "perfect" as a sequence that can be recombined with itself by the respective recombinase.

The utility of using a chimeric TALER containing a permissive recombinase domain, is that these TALERs will function to mediate recombination between a donor construct where the donor recombination site is designed to comprise a perfect permissive recombinase core sequence and a host-cell target recombination site where the sequence can be most other sequences as long as there are two TALE binding sites positioned the correct distance from one another and in the correct orientation. Preferably, the sequence of the donor target recombination site and the sequence of the host cell target recombination site share the same central 2 bp, or near central 2 bp, where TALER-mediated recombination will occur.

For each of the N-TALER and C-TALER reporter constructs used herein, the following sequence is defined as a perfect Gin sequence: TCCAAAACCATGGTTTACAG (SEQ ID NO:18). Given that GinL7C7-EE2 was selected based on its ability to recombine two GinE sites, GinE is also a perfect Gin site. Given that both Gin (TCCAAAACCATG-GTTTACAG; SEQ ID NO:18) and GinE (GTGAGCAC-CATGGAGCTGGC; SEQ ID NO:184) have seven identical nucleotides at the center of the recombination sequence, it is postulated that other perfect sites for the serine recombinase catalytic domain derived from GinL7C7-EE2 are possible.

To explore the flexibility of mediating recombination between non-identical TALER central sequences, a series of N-TALER reporter constructs were designed (Table 30). For these N-TALER reporter constructs the two TALER central sequences flanking the LacZ reporter gene, arbitrarily designated site 1 or site 2, comprised the recombinase core sequences listed in Table 29. Each of these N-TALER reporter constructs were co-transformed individually with the pN-TALER-IV-1 or pN-TALER-IV-5 chimera expression constructs. If non-Gin20 sites were recombined, then the resulting colonies would be white. If non-identical sites were recombined, then the resulting colonies would be white.

As can be see from the data in Table 30, for both pN-TALER chimera expression constructs (pN-TALER-IV-1 or pN-TALER-IV-5), when the N-TALER reporter construct had one TALER recombination site comprising a Gin20 recombinase core sequence, then recombination occurred as evidenced by white colonies. In contrast, when the N-TALER reporter construct did not have a TALER recombination site comprising a Gin20 recombinase core sequence, then recombination did not occur, as evidenced by blue colonies.

TABLE 29

Synthetic N-TALER central sequences for N-TALER reporter constructs.

| SEQ ID NO: | Site name | N-TALER central sequence |  |  |
|---|---|---|---|---|
|  |  | 5' TALE binding site | Recombinase core sequence | 3' TALE binding site |
| 4 | Gin20 | AGAAGGTATTTATA | TCCAAAACCATGGTTTACAG | TATAAATACCTTCT |
| 185 | DnaK_01 | AGAAGGTATTTATA | GATAGAACCTACACAGCAATACGAGAAATGTGTAATTTGG | TATAAATACCTTCT |
| 186 | DnaK_02 | AGAAGGTATTTATA | GGGATTCATATTATAGGCGA | TATAAATACCTTCT |
| 187 | Cp4 | AGAAGGTATTTATA | GCTTCGTCCTCTTAAGGTCATGTCTTCTGTTTCCACGGCG | TATAAATACCTTCT |
| 188 | Zm5.1 | AGAAGGTATTTATA | TGATGAATTCATCAATCAAGCT | TATAAATACCTTCT |

Central di-nucleotide where recombinase-mediated recombination occurs indicated by bold underline.

TABLE 30

N-TALER reporter constructs co-transformed with either the pN-TALER-IV-1 or pN-TALER-IV-5 chimera expression constructs.

| Name of reporter Site 1/Site 2 | Site 1 Recombinase core sequence | Site 2 Recombinase core sequence | Recombination? |
|---|---|---|---|
| DnaK_01/Gin20 | GATAGAACCTACACAGCAATACGAGAAATGTGTAATTTGG | TCCAAAACCATGGTTTACAG | yes |
| DnaK_01/DnaK_01 | GATAGAACCTACACAGCAATACGAGAAATGTGTAATTTGG | GATAGAACCTACACAGCAATACGAGAAATGTGTAATTTGG | no |
| DnaK_02/Gin20 | GGGATTCATATTATAGGCGA | TCCAAAACCATGGTTTACAG | yes |
| DnaK_02/DnaK_02 | GGGATTCATATTATAGGCGA | GGGATTCATATTATAGGCGA | no |
| CP4/Gin20 | GCTTCGTCCTCTTAAGGTCATGTCTTCTGTTTCCACGGCG | TCCAAAACCATGGTTTACAG | yes |
| CP4/CP4 | GCTTCGTCCTCTTAAGGTCATGTCTTCTGTTTCCACGGCG | GCTTCGTCCTCTTAAGGTCATGTCTTCTGTTTCCACGGCG | no |
| Zm5.1/Gin20 | TGATGAATTCATCAATCAAGCT | TCCAAAACCATGGTTTACAG | yes |
| Zm5.1/Zm5.1 | TGATGAATTCATCAATCAAGCT | TGATGAATTCATCAATCAAGCT | no |

Where white colonies indicate recombination occurred, and blue colonies indicated no recombination occurred.

For each of these reporters showing recombination between a perfect Gin central sequence and an imperfect Gin central sequence (i.e., DnaK-01, DnaK_02, CP4, or Zm5.1), the specific site of recombination in the imperfect sequence varied among different colonies or among plasmids within a colony. The di-nucleotide underlined is the predicted di-nucleotide that will be used in recombination. Experimental data support that it is the most common site of recombination except for DnaK_02. The results of sequencing the recombined reporters are shown below, and in all cases the upper case sequence is from the imperfect site and the lower case sequence is from the perfect Gin site.

For recombined reporters with one site containing a recombinase core sequence from CP4, there were two sites within the imperfect CP4 recombinase core sequence where recombination took place (seq underlined). This is represented here where, prior to recombination, the CP4 recombinase core sequence was:

(SEQ ID NO: 189)
GCTTCGTCCTCTTAAGGTCATGTCTTCTGTTTCCACGGCG.

After recombination the recombinase core sequences were:

Most common outcome:
(SEQ ID NO: 190)
GCTTCGTCCTCTTAAGGTCAtggtttacag

Alternative outcome:
(SEQ ID NO: 191)
GCTTCGTCCTCTTAAGGTCATGTCTTCTGTtggtttacag.

Note that for the alternative outcome, the recombination took place between two di-nucleotides that do not match (AT and TT). The most common outcome was found in 4 of 8 colonies tested, the alternative outcome was found in 2, and 2 colonies had a mix of both sequences (double peaks) with mostly the common, with a smaller amount of the alternative.

Similar to the result for the reporter with one CP4 recombinase core sequence, a similar pattern was seen for reporters with one site comprising either the Dnak_01 or DnaK_02 recombinase core sequences, as seen below.

DnaK_01 recombinase core sequence was:

(SEQ ID NO: 192)
GATAGAACCTACACAGCAATACGAGAAATGTGTAATTTGG.

After recombination the recombinase core sequences were:

```
Most common outcome:
                              (SEQ ID NO: 193)
GATAGAACCTACACAGCAAtggtttacag Outcome #2:
                              (SEQ ID NO: 194)
GATAGAACCTAatggtttacag.
```

Note that for alternative outcome #2, recombination took place between two di-nucleotides that do not match.
DnaK_02 recombinase core sequence was:

```
    GGGATTCATATTATAGGCGA    (SEQ ID NO: 195)
```

After recombination the recombinase core sequences were:

```
                              Outcome #1:
    (SEQ ID NO: 196)
    GGGATTCAtggtttacag Outcome #2:
                              (SEQ ID NO: 197)
    GGGATTCATAtggtttacag Outcome #3:
                              (SEQ ID NO: 198)
    GGGATTCATATAtggtttacag Outcome #4:
                              (SEQ ID NO: 199)
    GGGATTCATATTAtggtttacag.
```

Outcomes #1 and #4 occurred with equal frequency, while outcome #2 was almost as frequent and outcome #3 was infrequent. Note that for outcome #3, this sequence is not expected from a recombination reaction involving exchange of just two di-nucleotides.
Zm5.1 recombinase core sequence was:

```
    TGATGAATTCATCAATCAAGCT    (SEQ ID NO: 200)
```

After recombination the recombinase core sequence was:

```
    Outcome:
                              (SEQ ID NO: 201)
    TGATGAATTCAtggtttacag.
```

Most reads were clean with only a few having small double peaks.
Randomized Single Recombination Site Gin Library Because the four non-Gin20 recombinase core sequences tested in these experiments contain some similarity to the Gin20 site (Table 29), additional experiments were conducted to determine the extent of sequence diversity that can be tolerated when only one of the two target sites is a perfect Gin site. In these experiments the Gin20 site is the perfect Gin site for the recombinase catalytic domain GinL7C7-EE2.

For these experiments, two libraries of N-TALER reporter constructs were generated, where the recombinase core sequence of either the TALER central sequence 1 or 2, flanking the LacZ gene, were randomized. For each library, the central AT di-nucleotide of the recombinase core sequence was kept constant, and the remaining 18 nucleotides of the 20 nucleotides of the recombinase core sequence were randomized. For both libraries, the starting template was the N-TALER reporter Gin20TALE+0.

The libraries were generated by PCR of the linearized Gin20TALE+0 reporter construct with one specific PCR primer and one PCR primer that contained a randomized recombinase core sequence (except for the central AT di-nucleotide) and both flanking by TALE-13 binding sites. The resulting PCR products were digested with a unique restriction enzyme and self ligated. The initial plasmid linearization was done in a manner to prevent background template from contaminating the results. The ligations 11 and 13 randomized site 1, and ligations 12 and 14 randomized site 2. Ligations 11 and 12 utilized NEB Quick Ligation™ buffer and T4 ligase (New England Biolabs, Ipswich, Mass.). Ligations 13 and 14 utilized Roche Rapid Ligation Buffer and Rapid ligase (Roche Diagnostics Co., Indianapolis, Ind.). Ligations 11_A, 12_A, 13_A, and 14_A included aliquots of the library of reporters without additional purification steps. Ligations 11_B, 12_B, 13_B, and 14_B included aliquots of the library of reporters with the addition of a QIAquick PCR purification step (QIAGEN Sciences, Germantown, Md.).

To determine if recombination would occur with a randomized site, aliquots of the two libraries were transformed with or without the pN-TALER-IV-1 chimera expression construct. As negative controls, a reporter construct containing only a wild-type Gin site, and no TALE DNA-binding site, was used to co-transform with and without the pN-TALER-IV-1 chimera expression construct. The transformed bacteria were plated on chloramphenicol/kanamycin (chlor/kan), chlor, or kan selection plates. As expected, for transformations containing only a library of reporter construct and no pN-TALER-IV-1 chimera expression construct, no colonies grew on chlor/kan or kan plates Likewise, for transformations containing the library of reporter constructs with or without the pN-TALER-IV-1 chimera expression construct, only blue colonies grew on chlor plates. As evidenced by the appearance of white colonies on chlor/kan plates, the co-transformation with pN-TALER-IV-1 chimera appeared to recombine reporters from the following libraries Lig_11_B_2, Lig_12_B_2, Lig_13_B_2, and Lig_14_B_2 (Table 31).

These results indicate that the pN-TALER-IV-1 is tolerant of sequence diversity at one recombination site, when paired with a perfect Gin site at the second recombination site. This conclusion is based on the fact that the majority of resulting colonies from the randomized library constructs co-transformed with pN-TALER-IV-1 were white. There were some blue colonies, but it should be noted that even when both sites are perfect Gin sites, blue colonies result at a low frequency. By subtracting the background level of blue colonies when both sites are perfect from the observed frequency of blue colonies produced using the randomized library, a percentage of permitted sequences can be estimated.

TABLE 31

Results of N-TALER reporter with randomized recombinase core sequence co-transformed with pNTALER-IV-1 chimera construct.

| Reporter library | Recombinase | Plate Results | | |
|---|---|---|---|---|
| | | Chlor/Kan | Chlor | Kan |
| Lig_11_A_1 | none | 0 | ~25 blue | 0 |
| Lig_11_A_2 | pN-TALER-IV-1 | 0 | ~50 blue | ~200 white |
| Lig_11_B_1 | none | 0 | blue lawn | 0 |
| Lig_11_B_2 | pN-TALER-IV-1 | ~100 white/1blue | blue lawn | white lawn |
| Lig_12_A_1 | none | 0 | ~12 blue | 0 |
| Lig_12_A_2 | pN-TALER-IV-1 | 0 | ~50 blue | ~100 white |
| Lig_12_B_1 | none | 0 | blue lawn | 0 |
| Lig_12_B_2 | pN-TALER-IV-1 | ~100 white/12 blue | blue lawn | white lawn |
| Lig_13_A_1 | none | 0 | ~100 blue | 0 |
| Lig_13_A_2 | pN-TALER-IV-1 | 0 | ~100 blue | ~300 |
| Lig_13_B_1 | none | 0 | blue lawn | 0 |
| Lig_13_B_2 | pN-TALER-IV-1 | ~100 white/4 blue | blue lawn | white lawn |
| Lig_14_A_1 | none | 0 | ~25 blue | 0 |
| Lig_14_A_2 | pN-TALER-IV-1 | 0 | ~50 blue | ~200 white |
| Lig_14_B_1 | none | 0 | blue lawn | 0 |
| Lig_14_B_2 | pN-TALER-IV-1 | ~100 white/4 blue | blue lawn | white lawn |
| Gin20TALE13+0 | none | 0 | blue lawn | 0 |
| Gin20TALE13+0 | pN-TALER-IV-1 | white lawn/-25 blue | blue lawn | white lawn |

To determine the sequence diversity of randomized sites in the separate libraries of N-TALER reporter, the two libraries were transformation without a pN-TALER-IV-1 chimera expression construct and plated, individual colonies were picked for 96-well plate plasmid prep, from which there were 88 recovered plasmids. Aliquots of 88 individual plasmid preps were then pooled (6 pools representing the site 1 library and 5 pools representing the site 2 library, and these pooled N-TALER reporters were co-transformed with the pN-TALER-IV-1 chimera expression construct and were plated on chlor/kan plates. For six of the eleven pools tested, the ratio of white to blue colonies was the same as the ratio of white to blue colonies when an N-TALER reporter containing two perfect Gin sites was used, suggesting that all of the reporters from the library pool were recombined. For three pools, less than 20% of the colonies were blue indicating that approximately one of the reporters was not efficiently recombined. In two pools, about half of the colonies were blue indicating that 2-4 reporters were not efficiently recombined.

To determine the sequence diversity represented in the randomized library of candidate recombinase central sequences, the individual plasmids from the pooled library reporter constructs, were sequenced. Readable sequence was returned for 58 constructs. The sequencing results indicated that none of the 58 variations in sequence was represented more than once, and none of the sequences were from the starting construct, i.e., a perfect Gin site (Table 32).

Of the 88 N-TALER reporter constructs tested in the pools, 7-11 plasmids were not efficiently recombined, as estimated by the number blue colonies. Although not all of the reporters were sequenced, we noticed that in several of the pools that had at least one reporter that did not recombine (higher number of blue colonies), there was a sequence with many Gs and Cs (e.g., CGCCCCCCCATCCCCCCGC; SEQ ID NO:202). In contrast, in the pools where all reporters were efficiently recombined (as evidenced by essentially all white colonies), there were not sequences with many Gs and Cs.

TABLE 32

Diversity of randomized sites recombined in N-TALER reporter libraries co-transformed with the pN-TALER-IV-1 chimera expression construct.

| SEQ ID NO: | Library colony number | Random site (5' to 3') |
|---|---|---|
| 203 | lig_3_2 | CATACATCCATACTTGTAAT |
| 204 | lig_3_3 | AAGTGACAAATCTTACTACT |
| 205 | lig_3_4 | CGAGCCGCGATACTATGCTA |
| 206 | lig_3_5 | TACTCTCTGATTGCCGGCCT |
| 207 | lig_3_7 | CGCTCAGACATATTCCGCAG |
| 208 | lig_3_8 | CCAACCAGTATTAAACCCAC |
| 209 | lig_3_9 | TGAACTTGCATCAGGCCTCA |
| 210 | lig_3_11 | CTTTTTTACATCCTCACGGA |
| 211 | lig_3_12 | ATGTCACGCATCCCTAGCGC |
| 212 | lig_3_13 | TGACCGTAAATCCTATCCGG |
| 213 | lig_3_16 | GCAGAGATTATCCTTTGGAT |
| 214 | lig_3_17 | CGTCATACCATAAACCCCCG |
| 215 | lig_3_18 | GCCGAATAGATTCCCACCCT |
| 216 | lig_3_19 | CAGGTCCTATCCCTTATCC |
| 217 | lig_3_20 | CCCTCCCTTATGACACTCC |
| 218 | lig_3_21 | AGCCTACACATAGAATATTA |
| 219 | lig_3_22 | TAACGGTCCATCACCGACAA |
| 220 | lig_3_24 | CAGTAGTATATGTACCGTTG |
| 221 | lig_3_25 | AGACACTTAATCTGAGGCCA |
| 222 | lig_3_26 | CCCACTACCATCTTTGCGCA |
| 223 | lig_3_27 | GTGAGCTCTATTCATACGAC |

TABLE 32-continued

Diversity of randomized sites recombined in N-TALER reporter libraries co-transformed with the pN-TALER-IV-1 chimera expression construct.

| SEQ ID NO: | Library colony number | Random site (5' to 3') |
| --- | --- | --- |
| 224 | lig_3_28 | GATTCCCCGATTCGCCACTC |
| 225 | lig_3_31 | CTATCGCGGATAGCCCTACC |
| 226 | lig_3_32 | CCGGCAATCATACGCCATAC |
| 227 | lig_3_33 | GATGCTAAATTGGCAAC |
| 228 | lig_3_35 | ACCCCCCCTATCCAGCCACG |
| 229 | lig_3_36 | cAGCCGTCATCCCGACGGA |
| 230 | lig_3_37 | AGCCGCGTCATACTAGATCA |
| 231 | lig_3_38 | CGCCCCCCCATCCCCCCCGC |
| 232 | lig_3_39 | CCGCCGACGATAGATCAACC |
| 233 | lig_3_41 | CCTCTCCCAATTTCCTACGT |
| 234 | lig_3_43 | CTACCTCCATTCCACACGC |
| 235 | lig_3_44 | ACCTACGCTATCACGGCATT |
| 236 | lig_3_45 | CGCGCACCAATTCTCCCCTC |
| 237 | lig_3_46 | TGACGAAATATATTACTGCG |
| 238 | lig_3_47 | ATGAGTAAAATTGTACGCGA |
| 239 | lig_3_48 | CCCCCTAACATACATTGAGT |
| 240 | lig_6_1 | AGGATAGACATTTAAACTCA |
| 241 | lig_6_2 | CCATCTACAATCTAACCGCC |
| 242 | lig_6_3 | AAGTTAGATATAAGGCAATG |
| 243 | lig_6_4 | TTAAAGTTAATTGGGAGCAG |
| 244 | lig_6_5 | TTGCCTTCGATTCAGCCACA |
| 245 | lig_6_6 | TAATCTACGATTGTCCATAC |
| 246 | lig_6_7 | TCAAATTAAATTGTCGAATC |
| 247 | lig_6_9 | CCCACGATAATTTCCGACCG |
| 248 | lig_6_10 | CCTACTCCGATTCGGAACCC |
| 249 | lig_6_12 | ACCTATTATATCTAATAAAC |
| 250 | lig_6_13 | TCTTGCTGCATCGATCGTCC |
| 251 | lig_6_15 | GGGGGAAGAATCGCCTGACG |
| 252 | lig_6_16 | TGAAGAATAATACATGAATA |
| 253 | lig_6_18 | CGACGCGATATACCATACCT |
| 254 | lig_6_21 | CCACAACCCATTCGCCGCCC |
| 255 | lig_6_22 | ACCCGCGATATTGGTCGATG |
| 256 | lig_6_23 | AAAGCCTGAATTATTGGAGT |
| 257 | lig_6_24 | CGCACGTAAATAAACACGTA |

These results demonstrate that the pN-TALER-IV-1, containing the serine recombinase catalytic domain from GinL7C7-EE2 is able to recombine two TALER central sequences when one recombinase core sequence is a perfect Gin site and the second recombinase core sequence is diversified. These results suggest that selecting any site in the host genome which is not G-C rich will likely be a sufficient target site for TALER-mediated targeting. In Proudfoot (2011), the investigators performed molecular evolution on the ZFRs to identify a variation in the Tn3 recombinase catalytic domain that would allow the ZFR to work on some sequences found in the human genome. They found that the evolved ZFR worked on some, but not all similar sequences. However, they did observe recombination between the original Tn3 site and sites that did not recombine with themselves. Therefore, it is postulated that other Gin recombinase variants, as well as other small serine recombinases, can be foundthat will allow recombination between a perfect sequence and many other sequences.

Previously we showed that TALER central sequences with 18 bp of the Gin sequence were efficiently recombined by both a specific sIV-1 TALER and the permissive pIV-1 TALER. When only 16 bps of the Gin site was left between the TALE binding sites, recombination still occurred but was less efficient and 14 bp was very inefficiently recombined (Table 18). In these experiments, the total distance between the TALE binding sites was 16 and 14 bp, respectively. Because we varied the distance between TALE binding sites as well as removing bases from the Gin recombinase core sequence, we could not determine if the reduced recombination efficiency was due to spatial requirements needed for the specific nucleotides of the Gin recombinase core sequence.

To determine how much of the Gin20 sequence is required for recombination when the central sequence is maintained at a permitted length, N-TALER reporters were generated with a 20 bp recombinase central sequence between the TALE binding sites, where either the central 12 bp, or the central 10 bp, or the central 8 bp of the recombinase core sequence were held constant, and the remaining nucleotides were different from the Gin sequence. The N-TALER reporter with 12 bp was designated R45, the N-TALER reporter with 10 bp was designated R46, and the N-TALER reporter with 8 bp was designated R47. A N-TALER reporter with a 10 bp site 1 and a 12 bp site 2 was designated R46B, and a N-TALER reporter with a T and an A flanking the central AT di-nucleotide was designated R48 (see Table 33). The various reporters, including the pSC101 Gin20TALE13+0 were co-transformed with either sN-TALER-IV-1 or pN-TALER-IV-1 and recombination, as determined by colony color, was scored (Table 33). For purposes of comparison, the GinE site that was used in the generation of the GinL7C7-EE2 recombinase domain (Gersbach et al., 2010) was also included.

To confirm that white colonies resulted from recombination, the colonies were analyzed by colony PCR and sequencing of the PCR product. For the reporter that retained 12 bp from the Gin site, 8 of 8 colonies analyzed had the predicted recombination product for both the sN-TALER-IV-1 chimera and the pN-TALER-IV-1chimera (16 colonies total analyzed, 8 each). Likewise, for the reporter that retained 8 bp from the Gin site co-transformed with the pN-TALER-IV-1 chimera, 14 of 14 colonies analyzed had the predicted recombination product.

The pN-TALER-IV-1 chimera was able to efficiently recombine all of the reporters tested in this experiment including the reporter with only 8 bp of identity to the Gin20 sequence. Thus, the most constrictive definition of the "core sequence" of TALERs with the GinL7C7-EE2 recombinase domain may be considered to be "ACCNNGGT." Given that the pN-TALER-IV-1 chimera also recombined the R48 reporter, the two nucleotides flanking the central di-nucleotides may also be varied. The sN-TALER-IV-1 chimera was able to efficiently recombine the reporter with 12 bp of identity to Gin20. Thus, the most constrictive definition of the "core sequence" of TALERs with the Gin(H106Y) recombinase domain may be considered to be AAAC-CNNGGTTT (SEQ ID NO:290).

a TALER central sequence, and these 12 bp in a native Gin recombinase core sequence are palindromic, a set of N-TA-LER reporter constructs could be designed with the conserved central base pairs as indicated in Table 34. For these recombinase core sequences, the size of the TALER central sequence (core plus spacers) could be adjusted to generate TALER central sequences of 18 to about 24 nucleotides, or 36 to about 42 nucleotides. TALER central sequence lengths can be 18, 20, or 40 bp, with a conserved central 12 bp recombinase core sequence. For pN-TALER-mediated recombination, the TALER central sequence lengths may be 16 to 42 bp., for example of 18, 20 or 40, with a conserved central 12 bp recombinase core sequence.

TABLE 33

Results of N-TALER reporters with differing consensus of recombinase core sequence co-transformed with sN-TLAER and pN-TALER reporter constructs.

| | | | Recombined Y/N (score) | |
|---|---|---|---|---|
| SEQ ID NO | Reporter | Sequences flanked by TALE sites | sN-TALER-IV-1 | pN-TALER-IV-1 |
| 18 | Gin | TCCAAAACCATGGTTTACAG | Y (1) | Y (1) |
| 177 | GinE | GTGAGCACCATGGAGCTGGC | N* | Y* |
| 258 | R45 (12bp) | TCTCAAACCATGGTTTCACT | Y (1.5) | Y (1) |
| 259 | R46 (10bp) | TCTCTAACCATGGTTACACT | Y*** (4.5) | Y (1.5) |
| 259/258 | R46B (10bp/12 bp) | TCTCTAACCATGGTTACACT/ TCTCAAACCATGGTTTCACT | N (5) | Y (1) |
| 260 | R47 (8bp) | TCTCTGACCATGGTCACACT | N (5) | Y¹ (1.5) |
| 261 | R48 | TCCAAAACTATAGTTTACAG | Y***(4.5) | Y¹ (1.5) |

*As reported by Gersbach et al., 2010.
**With reduced efficiency as evidenced by sectored colonies. Restreaked colonies were white, indicating recombination.
***Inefficient recombination.

Importance of the Central 2 bp for the "Perfect" Sequence

Previous publications show that for the Gin serine recombinase, several different di-nucleotide pairs function at the center of the recombination site (e.g., Gordley et al., 2007). Based on these reports, the following recombinase core sequences of the recombinase core sequences of N-TALER central sequences were tested using the bacterial reporter system described above: TCCAAAACCATGGTTTACAG (SEQ ID NO:18); TCCAAAACCAAGGTTTACAG (SEQ ID NO:262); TCCAAAACCTCGGTTTACAG (SEQ ID NO:263). For these N-TALER reporter constructs, both TALER central sequences had the identical recombinase core sequence being tested (i.e., SEQ ID NOs:18, 262, or 263). Each of the N-TALER reporters with these recombinase core sequences were co-transformed with either the sN-TALER-IV-1 or the pN-TALER-IV-1. Based on white colonies, the results indicate that each of the recombinase core sequences is efficiently recombined by both N-TALER chimeras.

Given that only the central 12 bp of a recombinase core sequence are critical for TALER-mediated recombination of

TABLE 34

Recombinase core sequences with a conserved central 12 bp recombinase core sequence.

| SEQ ID NO: | TALER central sequence |
|---|---|
| 264 | NNNNAAACCATGGTTTNNNN |
| 265 | NNNNAAACCAAGGTTTNNNN |
| 266 | NNNNAAACCTTGGTTTNNNN |
| 267 | NNNNAAACCTCGGTTTNNNN |
| 268 | NNNNAAACCGAGGTTTNNNN |

It is anticipated that TALERs with other architectures (e.g., N-TALERs with longer linkers, sN-TALLER-IV-14 or pN-TALER-IV-14, or C-TALERs) will mediate recombination of TALER central sequences if 12 bp of the recombinase core sequence is within a TALER central sequence 18 to 50, or more nucleotides in length. The 12 bp recombinase core sequence can be positioned in the middle of the TALER central sequence of a TALER central sequence. It is contemplated that the TALER central sequence, which is flanked by either N-TALER or C-TALER TALE binding sites, contains a critical number of base pairs (e.g., 12 in this case) as the recombinase core sequence and the remainder of the TALER central sequence can be designed to be an optimal spacing for a particular N-TALER or C-TALER chimera.

Based on the results in Table 33, where a recombinase core sequence of 8 bp was recombined by a pN-TALER but not a sN-TALER, then similar to the spacing requirements for the 12 bp recombinase core sequence, an 8 bp recombinase core sequence within a longer TALER central sequence should be recombined by pN-TALER-IV-1, though possibly with less efficiency (Table 35). Note that the size of the central sequence may be 18 to 50 bp, or more depending on the TALER architecture used (i.e., pN-TALER-IV-14, or C-TALER).

TABLE 35

Recombinase core sequences with conserved central 8 bp recombinase core sequence.

| SEQ ID NO: | TALER central sequence |
|---|---|
| 269 | NNNNNNACCATGGTNNNNNN |
| 270 | NNNNNNACCAAGGTNNNNNN |
| 271 | NNNNNNACCTTGGTNNNNNN |
| 272 | NNNNNNACCTCGGTNNNNNN |
| 273 | NNNNNNACCGAGGTNNNNNN |

Recombination of Varying Central Di-Nucleotide

To determine the diversity of the central di-nucleotide based of a recombinase core sequence, two N-TALER reporter constructs were created where in the respective recombinase core sequences of the two TALER central sequences varied (Table 36). These N-TALER reporters were individually co-transformed with the sN-TALER-IV-1 chimera expression construct and the colonies produced by these two constructs were blue. Colony PCR and sequence analysis of 16 of these blue colonies indicated that the colonies that were transformed with the N-TALER reporter (AA/TT) contained plasmids with either the LacZ cassette in an inverted orientation (e.g. recombination occurred to flip the sequence orientation), or there was a mixture of inverted and non-inverted LacZ cassettes. This result indicated that sN-TALER-IV-1-mediated recombination in an oriented fashion so that the LacZ cassette was not removed, only flipped back and forth. This outcome would be expected because the central two base pairs are in an "opposite" configuration. In contrast, for the colonies that were transformed with the N-TALER reporter (CC/GG), none of the colonies (n=16) had the LacZ cassette flipped, indicating that N-TALER-IV-1 did not mediate recombination with this reporter.

Unlike for sN-TALER-IV-1 chimera, when these two N-TALER reporter constructs (AA/TT and CC/GG) and the pN-TALER-IV-1 chimera expression construct were co-transformed into bacteria, all of the resulting colonies were white, indicating that the pN-TALER-IV-1-mediated recombination to remove or disrupt the LacZalpha cassette. Thus, it appears that the pN-TALER-IV-1 is able to recombine sequences where the central two base pairs are not paired with their Watson-Crick partners after the two strands are exchanged. Furthermore, the recombinase core sequences of these two N-TALER reporters have not been previously demonstrated to conform to be a perfect Gin sites. Thus, these results indicate that either the CC or the GG or both sites are "perfect." Colony PCR and sequencing was done on white colonies from this experiment, and the results indicated that recombination may have occurred outside the TALER central sequences.

To investigate further the di-nucleotide combinations permitted in a recombinase core sequence, another N-TALER reporter construct (R31, GinTC/E) was generated, Table 36. In this N-TALER reporter, the two TALER central sequences had recombinase core sequences with a central di-nucleotide that did not have Watson-Crick base pairing. This N-TALER reporter co-transformed with sN-TALER-IV-1, pN-TALER-IV-1, and pN-TALER-IV-5 chimera expression constructs. For the co-transformation with the sN-TALER-IV-1chimera, all of the colonies were blue and no recombination was detected with PCR or sequencing. However, when either a pN-TALER-IV-1 or pN-TALER-IV-5 chimera was used, the colonies were white. Colony PCR and sequencing indicated that recombination had occurred. The PCR was performed using primers that are located outside of the LacZalpha cassette and TALER central sequences. A product of approximately 877 bp indicated a reporter that was not recombined. A product of approximately 470 bp indicated a reporter that was recombined. PCR results are shown in FIG. 12 where lanes 1-16 are from colonies with pN-TALER-IV-1+reporter GinTC/GinE; lanes 17-24 are from colonies with pN-TALER-IV-5+reporter GinTC/GinE; lanes 25-29 are from colonies with pN-TALER-IV-1+reporter Gin/Gin8; and lanes 30-36 are from colonies with non-functional TALER with reporter Gin/Gin.

Figure 12:
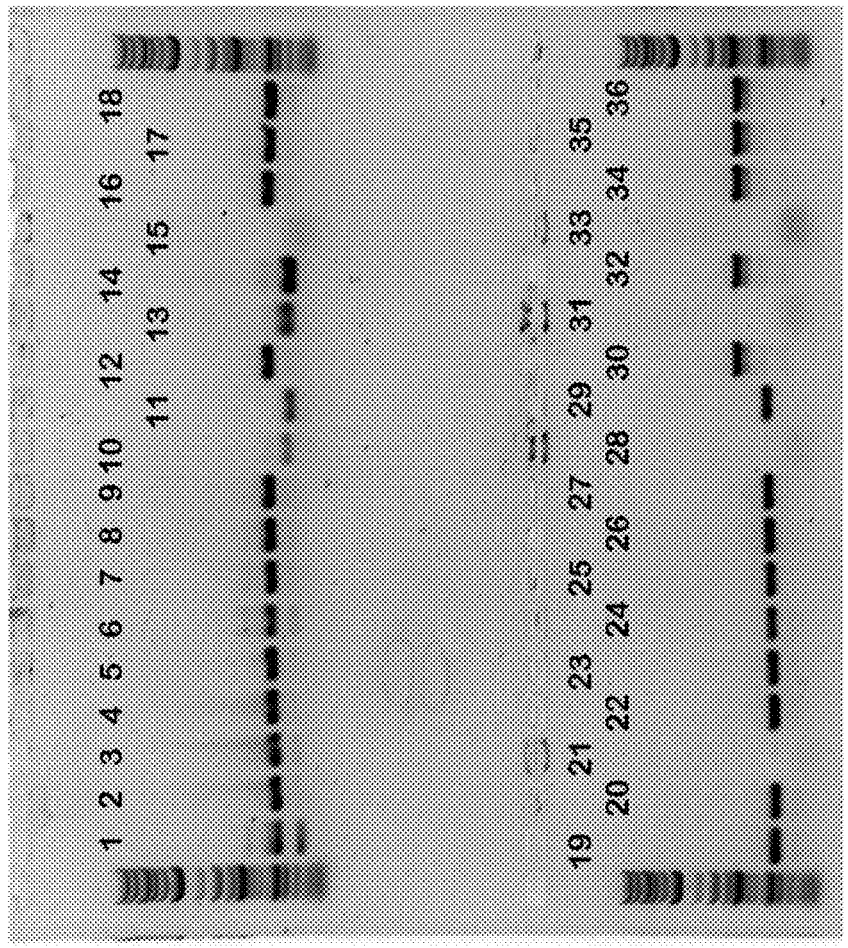
FIG. 12: Agarose gel separation of colony PCR products. Lanes 1-16 sampled from colonies with pN-TALER-IV-1+reporter GinTC/GinE; lanes 17-24 sampled from colonies with pN-TALER-IV-5+reporter GinTC/GinE; lanes 25-29 sampled from colonies with pN-TALER-IV-1+reporter Gin/Gin8; and lanes 30-36 sampled from colonies with a non-functional TALER with reporter Gin/Gin.

For the N-TALER reporter GinTC/E co-transformed with pN-TALER-IV-1 chimera expression constructs, the results of the PCR colony screen resulted in a band size which was expected for recombination (FIG. 12, lanes 1-16). A few of the colony PCR products were smaller than 470 bp (e.g., FIG. 12, lanes 10, 11, 13 and 14). Co-transformation with

TABLE 36

N-TALER reporter construct configurations with differing di-nucleotide pairs in N-TALER site 1 and site 2.

| Reporter | SEQ ID NO:Site 1 | | SEQ ID NO:Site 2 | |
|---|---|---|---|---|
| R26 | 274 | TCCAAAACCCCGGTTTACAG | 275 | TCCAAAACCGGGGTTTACAG |
| R28 | 276 | TCCAAAACCAAGGTTTACAG | 277 | TCCAAAACCTTGGTTTACAG |
| R31 (GinTC/E) | 278 | TCCAAAACCTCGGTTTACAG | 279 | GTGAGCACCATGGAGCTGGC |
| R92 (Gin/Gin8) | 280 | TCCAAAACCATGGTTTACAG | 281 | ACCATGGT | the pN-TALER-IV-5 chimera expression cassette produced only bands of ~470 bp (FIG. 12, lanes 17-24).

An additional N-TALER reporter (R92, Gin/Gin8) was generated with one TALER central sequence containing a perfect Gin recombinase core sequence and the second TALER central sequence containing a recombinase core sequence of only the 8 bp and no additional nucleotides for the TALER central sequence (e.g., only 8 bp between the two TALE binding sites). When a N-TALER reporter contains two TALER central sequences of only the central 8 bp of a Gin site, this reporter is not recombined by either the sN-TALER-IV-1 or the pN-TALER-IV-1 chimeras, presumably because the distance between the TALE binding sites is too small for the Gin dimer to fit. However, in the case of the Gin/Gin8 reporter, the pN-TALER-IV-1 was able to mediate recombination (FIG. 12, lanes 25-29). These results may be explained because the Gin site may be where the dimer (or even tetramer) of pN-TALER-IV-1 chimeras form, and this TALER couple is then able to recombine the Gin site with the Gin8 site.

Figure 13:
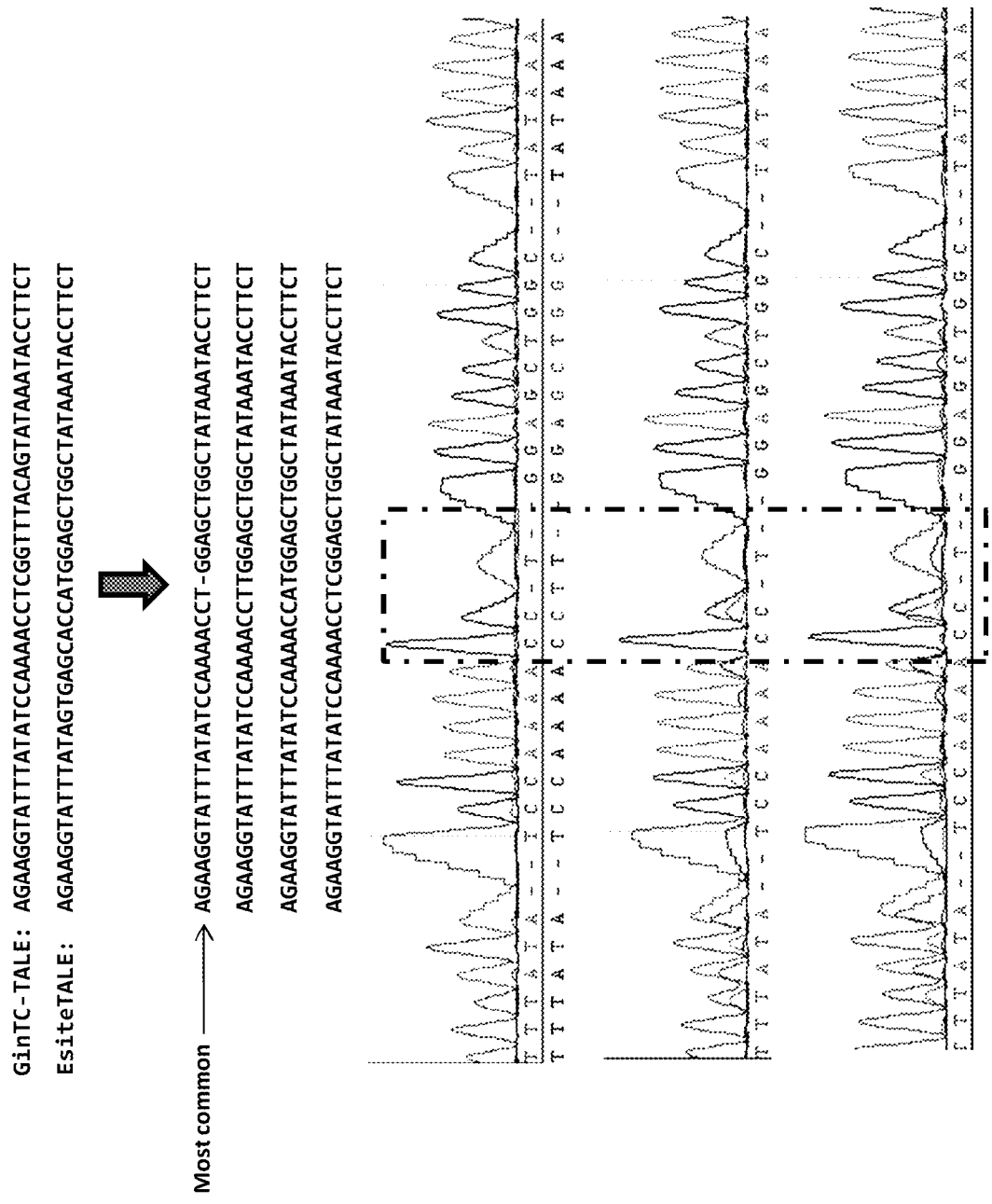
FIG. 13: PCR colony sequence analysis of N-TALER reporter and GinTC/GinE co-transformations showing recombination of asymmetric sites.

Sequence analysis of the PCR colony screen PCR product from the N-TALER reporter R31 (GinTC/GinE) experiments, indicated that recombination usually occurred at the two nucleotides between the CC and GG in the GinTC and GinE sites (FIG. 13, reads from right to left). In most cases, two or more recombination products are present that are detectable by the double peaks, observed starting at the site where one of the products recombined. For some of the products from the co-transformation of the N-TALER reporter, R31 (GinTC/E) and the pN-TALER-IV-1 chimera expression construct, the site of recombination was actually outside of the TALER central sequence (not shown). This is the presumed explanation for the bands smaller and larger than ~470 detected in the gel (FIG. 12, lanes 10, 11, 13 and 14). With the pN-TALER-IV-5 chimera, recombination did not occur outside of the TALER central sequence. The most common recombination product was TCCAAAACCTG-GAGCTGGC (SEQ ID NO:282) (FIG. 13), where this product is only 19 bp instead of the expected 20 bp.

For this reporter as well, the colonies were white. Sequence analysis indicated that the reporters had been recombined.

We observed that when colonies containing the reporter R31 (GinTC/E), or the reporter R28 (AA/TT), or the reporter R26 (CC/GG), which had been co-transformed with either the pN-TALER-IV-1 or pN-TALER-IV-5 chimera expression constructs, were allowed to continue growing on the media for a long time (more than two days), visual inspection indicated that the colonies did not have smooth edges. Additionally, small blue sectors, in otherwise white colonies, appeared near the edges. Because these sectors do not start at the center of the colony, they are independent of each other. Though the mechanism for the appearance of these blue sectors on the edges of these colonies is undetermined, they do not contain un-recombined reporter plasmid.

Not all possible combinations of different central dinucleotides within a recombinase core sequence have been tested, but these data show that for the permissive pN-TALERs, the central two by do not need to match for recombination to occur. Thus, it is likely that the central two by of the recombinase core sequence within a TALER central sequence can be any di-nucleotide pair. In contrast, for the sN-TALERs, the central two by of the recombinase core sequence within a TALER central sequence can not be CC or GG.

Based on the data presented, it is postulated that the following sites will be perfect TALER central sequences for pN-TALERs and pC-TALERs, NNNNAAACCNNG-GTTTNNNN (SEQ ID NO:283) or, somewhat less efficiently, NNNNNNACCNNGGTNNNNNN (SEQ ID NO:284).

REFERENCES

The following references, to the extent that they provide exemplary procedural or other details supplementary to those set forth herein, are specifically incorporated herein by reference.

Akopian et al., *Proc Natl Acad Sci USA* 100: 8688-8691, 2003
Boch et al., *Science*, 326, 1509-1512, 2009
Bogdanove and Voytas, *Science*, 333:1843-1846, 2011
Broothaerts et al., *Nature*, 443(7026):629-633, 2005
Buchholz and Hauber, *Methods*, 53(1):102-109 2011
Deng et al., *Science*, 335:720-723, 2012
Dhar et al., *Cell*, 119(1):33-45, 2004
Garcia-Otin and Guillou, *Frontiers in Bioscience*, 11:1108-1136, 2006
Gaj et al., *PNAS*, 108(2):498-503, 2011
Gelvin, *Microbiology and Molecular Biology Reviews*, 67(1):16, 2003
Gersbach et al., *Nucleic Acids Research*, 38(12):4198-4206, 2010
Gordley et al., *J. Mol. Biol.*, 367(3):802-813, 2007
Gordley et al., *PNAS*, 106(13): 5053-5058, 2009
Hellens et al., *Trends in Plant Science*, 5(10):446-451, 2000
Hughes et al., *EMBO J*, 11(7): 2695-2705, 1992
Lida et al., *Current Opinion in Biotechnology*, 15(2):132-138, 2004
Mak et al., *Science* 335, 716-179, 2012
Mercer et al., *Nucleic Acids Res.*, 40(21):11163-72, 2012
Miki et al., *Methods in Plant Molecular Biology and Biotechnology*, 1993
Miller et al., *Nature Biotechnology*, 29(2):143-148, 2011
Moscou and Bogdanove, *Science*, 326:1501, 2009
Nagy, *Genesis*, 26(2):99-109, 2000
Nern et al., 2011, *Proc Natl Acad Sci USA*. 108(34):14198-203, 2011
Proudfoot et al., *PLoS One*, 6(4):e19537, 2011
Rimphanitchayakit and Grindley, *EMBO J.*, 9(3): 719-725, 1990
Schornack et al., *J. Plant Physiology*, 163(3):256-272, 2006
Smith and Thorpe, *Molecular Microbiology*, 44(2):299-307, 2002
Sun et al., *Mol. Biosyst.*, 8(4):1255-1263, 2012
Torney et al., *Nature Nanotechnology* 2:1295-300, 2007
Turan and Bode, *FASEB Journal*, 25:4088-4107, 2011
Tucker et al, *Current Opinion in Structural Biology*, 15(3); 342-348, 2005
Vergunst et al., *Science*, 290(5493): 979-982, 2000
You et al. *Plant Physiology*, 140(4):1205-1212, 2006
Zhu and Sadowski, *J. Biol. Chem.* 270(39): 23044-23054, 1995

SEQUENCE LISTING (300 sequences)

SEQ ID NO: 1 - DNA, 56 bp, Artificial sequence
  Recombinant sequence
gcagtggcgggaggcgtgtccaaaaccatggtttacagcacgcctcccgccactgc

SEQ ID NO: 2 - DNA, 46 bp, Artificial sequence
  Recombinant sequence
agaaggtatttataccaaaaccatggtttacatataaataccttct

SEQ ID NO: 3 - DNA, 48 bp, Artificial sequence
  Recombinant sequence
agaaggtatttatatccaaaaccatggtttacaatataaataccttct

SEQ ID NO: 4 - DNA, 48 bp, Artificial sequence
  Recombinant sequence
agaaggtatttatatccaaaaccatggtttacagtataaataccttct

SEQ ID NO: 5 - DNA, 46 bp, Artificial sequence
  Recombinant sequence
agaaggtatttattccaaaaccatggtttacagataaataccttct

SEQ ID NO: 6 - DNA, 50 bp, Artificial sequence
  Recombinant sequence
agaaggtatttatattccaaaaccatggtttacagatataaataccttct

SEQ ID NO: 7 - DNA, 52 bp, Artificial sequence
  Recombinant sequence
agaaggtatttatatatccaaaaccatggtttacagtatataaataccttct

SEQ ID NO: 8 - DNA, 54 bp, Artificial sequence
  Recombinant sequence
agaaggtatttatataatccaaaaccatggtttacaggtatataaataccttct

SEQ ID NO: 9 - DNA, 56 bp, Artificial sequence
  Recombinant sequence
agaaggtatttatatatatccaaaaccatggtttacaggctatataaataccttct

SEQ ID NO: 10 - DNA, 58 bp, Artificial sequence
  Recombinant sequence
agaaggtatttatatattatccaaaaccatggtttacaggactatataaataccttct

SEQ ID NO: 11 - DNA, 60 bp, Artificial sequence
  Recombinant sequence
agaaggtatttatatagttatccaaaaccatggtttacaggacgtatataaataccttct

SEQ ID NO: 12 - DNA, 62 bp, Artificial sequence
  Recombinant sequence
agaaggtatttatataggttatccaaaaccatggtttacaggacggtatataaataccttct

SEQ ID NO: 13 - DNA, 64 bp, Artificial sequence
  Recombinant sequence
agaaggtatttatataggcttatccaaaaccatggtttacaggaccggtatataaataccttct

SEQ ID NO: 14 - DNA, 66 bp, Artificial sequence
  Recombinant sequence
agaaggtatttatataggcattatccaaaaccatggtttacaggacacggtatataaataccttct

SEQ ID NO: 15 - DNA, 68 bp, Artificial sequence
  Recombinant sequence
agaaggtatttatataggcacttatccaaaaccatggtttacaggaccacggtatataaataccttct

SEQ ID NO: 16 - DNA, 72 bp, Artificial sequence
  Recombinant sequence
agaaggtatttatataggcacacttatccaaaaccatggtttacaggaccacacggtatataaataccttct

SEQ ID NO: 17 - DNA, 78 bp, Artificial sequence
  Recombinant sequence
agaaggtatttatataggcacacatgttatccaaaaccatggtttacaggacgttcacacggtatataaataccttct

SEQ ID NO: 18 - DNA, 20 bp, Artificial sequence
  Recombinant sequence
tccaaaaccatggtttacag

SEQ ID NO: 19 - DNA, 1644 bp, Artificial sequence
  Recombinant sequence
cgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 20 - DNA, 1728 bp, Artificial sequence
  Recombinant sequence
gtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 21 - DNA, 1740 bp, Artificial sequence
  Recombinant sequence
ggaacagttgctgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 22 - DNA, 1779 bp, Artificial sequence
  Recombinant sequence
gcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 23 - DNA, 1893 bp, Artificial sequence
  Recombinant sequence
gtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 24 - DNA, 2070 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 25 - DNA, 2076 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaggtagtcgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 26 - DNA, 2085 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaagaggtagtagaagtcgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 27 - DNA, 2166 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaggaacagttgctgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 28 - DNA, 2163 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaagaggaagtgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 29 - DNA, 2175 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaagaggaagtggaacagttgctgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 30 - DNA, 2223 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaggaagatcaggatcaagagcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 31 - DNA, 2244 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaaagccgaagtcaggtgagtctggatctcctagagaaaaagcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 32 - DNA, 2358 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 33 - DNA, 2382 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 34 - DNA, 2352 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaagatagaagctcagatccaacctcacaaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 35 - DNA, 2349 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaagatagaagctcagatccaacctcacaaaccgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 36 - DNA, 2343 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaagatagaagctcagatccaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 37 - DNA, 2337 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaagctcagatccaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 38 - DNA, 2331 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaagctcagatccagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 39 - DNA, 2325 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaagctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 40 - DNA, 2319 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 41 - DNA, 2358 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaactgtagatagaagctcagatccaacctcacaaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 42 - DNA, 2337 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaagctcagatccaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 43 - DNA, 2331 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaagctcagatccagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 44 - DNA, 2319 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 45 - DNA, 2358 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcaggagggcgataccctggtggtttggaagctggaccgtctgggtcgctcagtgaaacatctgatctcgctggtcggcgaactgcgtgaacgcggtattaactttcgtagtctgaccgattgcgtcaacacgagctctccgatgggccgctttttctttcacgttatgggtgcgctggccgaagtggaacgtgaactgattgtcgaacgcacgatggctggtctggctgctgcccgctccaaaggtcgcattggtggccgtccgccgaaaactgtagatagaagctcagatccaacctcacaaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 46 - protein, 689 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKRALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 47 - protein, 691 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGSRALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 48 - protein, 694 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKRGSRSRALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 49 - protein, 721 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 50 - protein, 720 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKRGSVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 51 - protein, 724 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKRGSGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 52 - protein, 740 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGRSGSRAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 53 - protein, 747 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKPKSGESGSPREKAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 54 - protein, 785 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 55 - protein, 793 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 56 - protein, 783 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKDRSSDPTSQTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 57 - protein, 782 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKDRSSDPTSQTVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 58 - protein, 780 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKDRSSDPTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 59 - protein, 778 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSDPTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 60 - protein, 776 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSDPVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 61 - protein, 774 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 62 - protein, 772 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 63 - protein, 785 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 64 - protein, 778 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKSSDPTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 65 - protein, 776 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKSSDPVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 66 - protein, 772 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 67 - protein, 785 aa, Artificial sequence
  Recombinant sequence
MLIGYARVSTNGQSTDLQRDALVCAGCEQIFEDKLSGTRTDRPGLKRALERLQEGDTLVVWKLDRLGRSVKHLISLVGELRERGINFRSLTDCVNTSSPMGRFFFHVMGALAEVERELIVERTMAGLAAARSKGRIGGRPPKTVDRSSDPTSQTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 68 - DNA, 44 bp, Artificial sequence
  Recombinant sequence
agaaggtatttatacaaaaccatggtttactataaataccttct

SEQ ID NO: 69 - DNA, 42 bp, Artificial sequence
  Recombinant sequence
agaaggtatttataaaaaccatggtttatataaataccttct

SEQ ID NO: 70 - DNA, 40 bp, Artificial sequence
  Recombinant sequence
agaaggtatttataaaaccatggttttataaataccttct

SEQ ID NO: 71 - DNA, 38 bp, Artificial sequence
  Recombinant sequence
agaaggtatttataaaccatggtttataaataccttct

SEQ ID NO: 72 - DNA, 36 bp, Artificial sequence
  Recombinant sequence
agaaggtatttataaccatggttataaataccttct

SEQ ID NO: 73 - DNA, 34 bp, Artificial sequence
  Recombinant sequence
agaaggtatttataccatggtataaataccttct

SEQ ID NO: 74 - DNA, 32 bp, Artificial sequence
  Recombinant sequence
agaaggtatttatacatgtataaataccttct

SEQ ID NO: 75 - DNA, 13 bp, Artificial sequence
  Recombinant sequence
ataaataccttct

SEQ ID NO: 76 - DNA, 14 bp, Artificial sequence
  Recombinant sequence
tataaataccttct

SEQ ID NO: 77 - protein, 45 aa, Artificial sequence
  Recombinant sequence
KPKSGESGSPREKSGRKGGPSPGTSTSRDGSDPTVSTQGSGTSGG

SEQ ID NO: 78 - protein, 25 aa, Artificial sequence
  Recombinant sequence
KPKSGESGSPREKSGRKGGPSPGTS

SEQ ID NO: 79 - protein, 8 aa, Artificial sequence
  Recombinant sequence
GGSGKEGS

SEQ ID NO: 80 - protein, 26 aa, Artificial sequence
  Recombinant sequence
LTKAEWEQAGRLLAQGIPRKQVALIV

SEQ ID NO: 81 - protein, 95 aa, Artificial sequence
  Recombinant sequence
SSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKK

SEQ ID NO: 82 - protein, 87 aa, Artificial sequence
  Recombinant sequence
NNKQERTLFKELIKTNGVGPKLALAILSGMSAQQFVNAVEREEVGALVKLPGIGKKTAERLIVEMKDRFKGLHGDLFTPAADLVLTS

SEQ ID NO: 83 - protein, 12 aa, Artificial sequence
  Recombinant sequence
KKSSRAKKPAKK

SEQ ID NO: 84 - protein, 61 aa, Artificial sequence
  Recombinant sequence
SIVAQLSRPDPALAALTNDHLVALACLGGRPALDAVKKGLPHAPALIKRTNRRIPERTSHR

SEQ ID NO: 85 - protein, 24 aa, Artificial sequence
  Recombinant sequence
SIVAQLSRPDPALAALTNDHLVAL

SEQ ID NO: 86 - protein, 11 aa, Artificial sequence
  Recombinant sequence
SIVAQLSRPDP

SEQ ID NO: 87 - protein, 843 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKLTKAEWEQAGRLLAQGIPRKQVALIVVHHHHHH

SEQ ID NO: 88 - protein, 806 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKLTKAEWEQAGRLLAQGIPRKQVALIVVHHHHHH

SEQ ID NO: 89 - protein, 793 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKLTKAEWEQAGRLLAQGIPRKQVALIVVHHHHHH

SEQ ID NO: 90 - protein, 823 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKLTKAEWEQAGRLLAQGIPRKQVALIVVHHHHHH

SEQ ID NO: 91 - protein, 786 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKLTKAEWEQAGRLLAQGIPRKQVALIVVHHHHHH

SEQ ID NO: 92 - protein, 773 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKLTKAEWEQAGRLLAQGIPRKQVALIVVHHHHHH

SEQ ID NO: 93 - protein, 912 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKKVHHHHHH

SEQ ID NO: 94 - protein, 875 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKKVHHHHHH

SEQ ID NO: 95 - protein, 862 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKKVHHHHHH

SEQ ID NO: 96 - protein, 892 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKKVHHHHHH

SEQ ID NO: 97 - protein, 855 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKKVHHHHHH

SEQ ID NO: 98 - protein, 842 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKSSNSAAAAVSAATTSPQKSSRSSPKRAAVAKKTGAKKVAKKPAKKVAKKPAKKVVKKPAKKVVKKAVKAVKKAVKKVVKAVKTAKKSSKKSSAKKVHHHHHH

SEQ ID NO: 99 - protein, 912 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 100 - protein, 875 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 101 - protein, 862 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 102 - protein, 892 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 103 - protein, 855 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 104 - protein, 842 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 105 - protein, 912 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 106 - protein, 875 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSTSRDGSDPTVSTQGSGTSGGLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 107 - protein, 862 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSTSRDGSDPTVSTQGSGTSGGLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 108 - protein, 892 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 109 - protein, 855 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 110 - protein, 842 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSNNKQERTLFKELIKTNGVGPKLALAILSGMSAQQFVNAVEREEVGALVKLPGIGKKTAERLIVEMKDRFKGLHGDLFTPAADLVLTSVHHHHHH

SEQ ID NO: 111 - protein, 829 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKKSSRAKKPAKKVHHHHHH

SEQ ID NO: 112 - protein, 792 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKKSSRAKKPAKKVHHHHHH

SEQ ID NO: 113 - protein, 779 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKKSSRAKKPAKKVHHHHHH

SEQ ID NO: 114 - protein, 809 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKKSSRAKKPAKKVHHHHHH

SEQ ID NO: 115 - protein, 772 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKKSSRAKKPAKKVHHHHHH

SEQ ID NO: 116 - protein, 759 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKKKSSRAKKPAKKVHHHHHH

SEQ ID NO: 117 - protein, 825 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSVHHHHHH

SEQ ID NO: 118 - protein, 788 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSVHHHHHH

SEQ ID NO: 119 - protein, 775 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSTSRDGSDPTVSTQGSGTSGGLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSVHHHHHH

SEQ ID NO: 120 - protein, 805 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSVHHHHHH

SEQ ID NO: 121 - protein, 768 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSVHHHHHH

SEQ ID NO: 122 - protein, 755 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPKPKSGESGSPREKSGRKGGPSPGTSLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKGGSGKEGSVHHHHHH

SEQ ID NO: 123 - protein, 825 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSTSRDGSDPTVSTQGSGTSGGLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSVHHHHHH

SEQ ID NO: 124 - protein, 805 aa, Artificial sequence
  Recombinant sequence
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRKPKSGESGSPREKSGRKGGPSPGTSLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKGGSGKEGSVHHHHHH

SEQ ID NO: 125 - DNA, 46 bp, Artificial sequence
  Recombinant sequence
tataaataccttctccaaaaccatggtttacaagaaggtatttata

SEQ ID NO: 126 - DNA, 48 bp, Artificial sequence
  Recombinant sequence
tataaataccttcttccaaaaccatggtttacagagaaggtatttata

SEQ ID NO: 127 - DNA, 50 bp, Artificial sequence
  Recombinant sequence
tataaataccttctatccaaaaccatggtttacaggagaaggtatttata

SEQ ID NO: 128 - DNA, 52 bp, Artificial sequence
  Recombinant sequence
tataaataccttcttatccaaaaccatggtttacaggaagaaggtatttata

SEQ ID NO: 129 - DNA, 56 bp, Artificial sequence
  Recombinant sequence
tataaataccttcttttatccaaaaccatggtttacaggaaaagaaggtatttata

SEQ ID NO: 130 - DNA, 60 bp, Artificial sequence
  Recombinant sequence
tataaataccttctcgtttatccaaaaccatggtttacaggaaacgagaaggtatttata

SEQ ID NO: 131 - DNA, 64 bp, Artificial sequence
  Recombinant sequence
tataaataccttcttccgtttatccaaaaccatggtttacaggaaacggtagaaggtatttata

SEQ ID NO: 132 - DNA, 68 bp, Artificial sequence
  Recombinant sequence
tataaataccttctcgtccgtttatccaaaaccatggtttacaggaaacggtcgagaaggtatttata

SEQ ID NO: 133 - DNA, 72 bp, Artificial sequence
  Recombinant sequence
tataaataccttctaccgtccgtttatccaaaaccatggtttacaggaaacggtcgacagaaggtatttata

SEQ ID NO: 134 - DNA, 78 bp, Artificial sequence
  Recombinant sequence
tataaataccttctgctaccgtccgtttatccaaaaccatggtttacaggaaacggtcgacgctagaaggtatttata

SEQ ID NO: 135 - DNA, 88 bp, Artificial sequence
  Recombinant sequence
tataaataccttctagccagctaccgtccgtttatccaaaaccatggtttacaggaaacggtcgacgctagccaagaaggtatttata

SEQ ID NO: 136 - DNA, 88 bp, Artificial sequence
  Recombinant sequence
agaaggtatttataagccagctaccgtccgtttatccaaaaccatggtttacaggaaacggtcgacgctagccatataaataccttct

SEQ ID NO: 137 - DNA, 2562 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcgtgagtcgtgatccggttagcaccggttctggtcgcacggttgatccgggttcgggctcaggttctcgccagacgccggtttcctcaggcggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 138 - DNA, 2532 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcgtgagtcgtgatccggttagcaccggttctggtcgcacggttgatccgggttcgggctcaggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 139 - DNA, 2502 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcgtgagtcgtgatccggttagcaccggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 140 - DNA, 2478 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 141 - DNA, 2448 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 142 - DNA, 2412 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 143 - DNA, 2562 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcgtgagtcgtgatccggttagcaccggttctggtcgcacggttgatccgggttcgggctcaggttctcgccagacgccggtttcctcaggcggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 144 - DNA, 2532 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcgtgagtcgtgatccggttagcaccggttctggtcgcacggttgatccgggttcgggctcaggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 145 - DNA, 2502 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcgtgagtcgtgatccggttagcaccggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 146 - DNA, 2478 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcacgccggattcatcaacgcaaggttcgggcggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 147 - DNA, 2448 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaacgagccgcgacggttctgacccgacggtttcaacgcaaggttcaggcacgagcggtggcggttctggatctggaggttcaggtacttctgtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 148 - protein, 803 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSTSRDGSDPGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 149 - protein, 815 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSTSRDGSDPTVSTQGSGTSGGGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 150 - protein, 825 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSTSRDGSDPTVSTQGSGTSGGTPDSSTQGSGGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 151 - protein, 833 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSTSRDGSDPTVSTQGSGTSGGTPDSSTQGSGVSRDPVSTGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 152 - protein, 843 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSTSRDGSDPTVSTQGSGTSGGTPDSSTQGSGVSRDPVSTGSGRTVDPGSGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 153 - protein, 853 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSTSRDGSDPTVSTQGSGTSGGTPDSSTQGSGVSRDPVSTGSGRTVDPGSGSGSRQTPVSSGGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 154 - protein, 803 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSTSRDGSDPGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 155 - protein, 815 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSTSRDGSDPTVSTQGSGTSGGGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 156 - protein, 825 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSTSRDGSDPTVSTQGSGTSGGTPDSSTQGSGGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 157 - protein, 833 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSTSRDGSDPTVSTQGSGTSGGTPDSSTQGSGVSRDPVSTGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 158 - protein, 843 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSTSRDGSDPTVSTQGSGTSGGTPDSSTQGSGVSRDPVSTGSGRTVDPGSGSGSGGSGTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 159 - DNA, 2415 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgctcagccgtctgatgcttctccagctgctcaagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 160 - DNA, 2364 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 161 - DNA, 2325 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 162 - DNA, 2313 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 163 - DNA, 2280 bp, Artificial sequence
  Recombinant sequence
atgctgattggctatgtccgtgtctcaacgaatgaccaaaataccgacctgcaacgtaacgctctggtgtgtgcgggctgcgaacagattttcgaagataagctgtctggcacccgtacggaccgtccgggcctgaaacgtgcgctgaagcgcctgcagaaaggcgataccctggtggtttggaagctggaccgtctgggtcgctcaatgaaacatctgatctcgctggtcggcgaactgcgtgaacgcggtattaactttcgtagtctgaccgattccatcgacacgagctctccgatgggccgctttttcttttatgttatgggtgcgctggccgaaatggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 164 - DNA, 2415 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgctcagccgtctgatgcttctccagctgctcaagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 165 - DNA, 2364 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 166 - DNA, 2325 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 167 - DNA, 2313 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 168 - DNA, 2280 bp, Artificial sequence
  Recombinant sequence
atgctgattggctatgcccgtgtctcaacgaatggccaatcgaccgacctgcaacgtgacgctctggtgtgtgcgggctgcgaacagattttcgaagataagctgtctggcacccgtacggaccgtccgggcctgaaacgtgcgctggagcgcctgcagaaaggcgataccctggtggtttggaagctggaccgtctgggtcgctcagtgaaacatctgatctcgctggtcggcgaactgcgtgaacgcggtattaactttcgtagtctgaccgattccgtcgacacgagctctccgatgggccgctttttctttcacgttacgggtgcgctggccgaagtggaacgtgaactgattatcgaacgcacgatggctggtctggctgctgcccgcaacaaaggtcgcattggtggccgtccgccgaaaactgtagatagaagctcagatccaacctcacaaacctcaggatctggaggttcaggtacttctggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 169 - protein, 804 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSGSGGSGTSAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 170 - protein, 779 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 171 - protein, 766 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 172 - protein, 762 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 173 - protein, 751 aa, Artificial sequence
  Recombinant sequence
MLIGYVRVSTNDQNTDLQRNALVCAGCEQIFEDKLSGTRTDRPGLKRALKRLQKGDTLVVWKLDRLGRSMKHLISLVGELRERGINFRSLTDSIDTSSPMGRFFFYVMGALAEMERELIIERTMAGLAAARNKGRIGGRPPKTVDRSSDPTSQTSGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 174 - protein, 804 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSGSGGSGTSAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 175 - protein, 779 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 176 - protein, 766 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 177 - protein, 762 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 178 - protein, 751 aa, Artificial sequence
  Recombinant sequence
MLIGYARVSTNGQSTDLQRDALVCAGCEQIFEDKLSGTRTDRPGLKRALERLQKGDTLVVWKLDRLGRSVKHLISLVGELRERGINFRSLTDSVDTSSPMGRFFFHVTGALAEVERELIIERTMAGLAAARNKGRIGGRPPKTVDRSSDPTSQTSGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 179 - DNA, 2361 bp, Artificial sequence
  Recombinant sequence
atggctaccatcggttacattcgtgtctcaacgatcgaccaaaacatcgacctgcaacgcaacgcactgacctcggcaaactgtgaccgtattttcgaagatcgcatttcgggcaaaatcgccaaccgtccgggtctgaaacgcgcactgaaatatgtgaataagggcgataccctggtggtttggaaactggaccgtctgggtcgctccgtcaagaacctggtggccctgatttcagaactgcatgaacgtggcgcacattttcacagcctgaccgattctatcgacacgagtagcgcgatgggtcgctttttcttttacgttatgtctgctctggcggaaatggaacgtgaactgatcgtcgaacgcacgctagctggacttgctgcggcacgtgcccaaggtcgcctgggaggtcgtccgcgcgcgactgtagatagaagctcagatccaacctcacaaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 180 - protein, 786 aa, Artificial sequence
  Recombinant sequence
MATIGYIRVSTIDQNIDLQRNALTSANCDRIFEDRISGKIANRPGLKRALKYVNKGDTLVVWKLDRLGRSVKNLVALISELHERGAHFHSLTDSIDTSSAMGRFFFYVMSALAEMERELIVERTLAGLAAARAQGRLGGRPRATVDRSSDPTSQTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 181 - DNA, 2361 bp, Artificial sequence
  Recombinant sequence
atggctaccatcggttacattcgtgtctcaacggtgggccaaaacatcgacctgcaacgcaacgcactgacctcggcaaactgtgaccgtattttcgaagatcgcatttcgggcaaaatcgccaaccgtccgggtctgaaacgcgcactggaatatgtgaataagggcgataccctggtggtttggaaactggaccgtctgggtcgctccgtcaagaacctggtggccctgatttcagaactgcatgaacgtggcgcacattttcacagcctgaccgattctatcgacacgagttcggcgatgggtcgctttttcttttacgttatgtctgctctggcggaaatggaacgtgaactgatcgtcgaacgcacgctagctggacttgctgcggcacgtgcccaaggtcgcctgggaggtcgtccgcgagcgactgtagatagaagctcagatccaacctcacaaacctcagtggacctgcgtaccctgggctactctcaacaacaacaagaaaaaatcaaaccgaaagtgcgctcgaccgtggctcaacaccatgaagccctggttggtcatggctttacccatgcccacatcgttgcactgagccagcatccggccgcactgggtaccgttgccgtcaaatatcaggatatgattgcagctctgccggaagctacccatgaagcgatcgtgggtgttggcaaacagtggagcggtgcacgtgctctggaagctctgctgaccgtggccggtgaactgcgtggtccgccgctgcagctggacaccggccaactgctgaaaatcgcgaaacgtggcggtgtcacggcagtggaagctgttcatgcctggcgtaatgcactgaccggtgcaccgctgaatctgacgccggaacaggtggttgcgattgcctctaacatcggcggtaaacaggctctggaaaccgtccaacgtctgctgccggtgctgtgccaggcgcatggtctgacgccggaacaagtcgtggcaattgctagtaacggcggtaaacaggccctggaaaccgttcaacgcctgctgccggtcctgtgtcaggcacacggcctgacgccggaacaagttgtcgcgattgcctccaatatcggcggtaaacaagccctggaaaccgtgcaacgtctgctgccggttctgtgccaggcccacggcctgaccccggaacaagtggttgcaattgctagcaacatcggcggtaaacaagcgctggaaacggttcagcgtttattaccggttctgtgtcaggcacatggtctgaccccggcacaagtcgtggcgattgcctctaatatcggcggtaaacaggcactggaaaccgttcagcgcctgctgccggttctgcgtcaggcccacggtctgaccccggaacaagttgtcgcaattgctagcaacggcggtaaacaggcgctggaaacggttcaacgtttattaccggtcctgtgtcaggctcatggtctgaccccggcccaagtggttgccattgcctcgaatatcggcggtaagcaggccctggaaaccgtccaacgcctgctgccggtgctgtgtcaagcccacggcttaaccccggaacaggttgttgcaattgctagtcacgatggtggcaaacaggcgctggaaaccgttcaacgtttacttccggtgctgtgtcaagcgcacggattaaccccggaacaagtggtcgcgatcgcctcccacgatggtggtaaacaagcactggaaacggtgcagcgtctgctgccggtcctgtgccaagcccatggtctgacgccggaccaggtggttgccatcgcttcaaacggcggtggcaaacaagcgctggaaaccgtgcagcgcttattaccggtgctgtgtcaagctcatggcctgaccccggatcaggttgtggccatcgcctcgaatggtggcggtaaacaagctctggaaacggtgcagcgattactgccggttctgtgccaagctcacggattaacgccggaacaggtcgtcgcaattgctagccacgatggcggcaaacaggctctggaaacggtgcaacgcttattacctgttttatgtcaggcccatggtctgaccccggaacaggtcgtggcgattgcgagcaatggcggtggccgtccggcactggaaagcatcgtggcacagctgtctcgcccggatccggccctggccgcactgaccaatgaccatctggttgcactggcttgtctgggtggccgtccggccctggatgcagtgaaaaaaggtctgccgcacgcgccggccctgattaaacgcaccaatcgtcgcatcccggaacgtacgagccatcgtgttcatcaccatcaccatcactaa

SEQ ID NO: 182 - protein, 786 aa, Artificial sequence
  Recombinant sequence
MATIGYIRVSTVGQNIDLQRNALTSANCDRIFEDRISGKIANRPGLKRALEYVNKGDTLVVWKLDRLGRSVKNLVALISELHERGAHFHSLTDSIDTSSAMGRFFFYVMSALAEMERELIVERTLAGLAAARAQGRLGGRPRATVDRSSDPTSQTSVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQRLLPVLCQAHGLTPEQVVAIASNGGKQALETVQRLLPVLCQAHGLTPEQVVAIASNIGGKQALETVQRLLPVLCQAHGLTPEQVVAIASNIGGKQALETVQRLLPVLCQAHGLTPAQVVAIASNIGGKQALETVQRLLPVLRQAHGLTPEQVVAIASNGGKQALETVQRLLPVLCQAHGLTPAQVVAIASNIGGKQALETVQRLLPVLCQAHGLTPEQVVAIASHDGGKQALETVQRLLPVLCQAHGLTPEQVVAIASHDGGKQALETVQRLLPVLCQAHGLTPDQVVAIASNGGGKQALETVQRLLPVLCQAHGLTPDQVVAIASNGGGKQALETVQRLLPVLCQAHGLTPEQVVAIASHDGGKQALETVQRLLPVLCQAHGLTPEQVVAIASNGGGRPALESIVAQLSRPDPALAALTNDHLVALACLGGRPALDAVKKGLPHAPALIKRTNRRIPERTSHRVHHHHHH

SEQ ID NO: 183 - DNA, 20 bp, Artificial sequence
  Recombinant sequence
tgataatttataatatttcg

SEQ ID NO: 184 - DNA, 20 bp, Artificial sequence
  Recombinant sequence
gtgagcaccatggagctggc

SEQ ID NO: 185 - DNA, 68 bp, Artificial sequence
  Recombinant sequence
agaaggtatttatagatagaacctacacagcaatacgagaaatgtgtaatttggtataaataccttct

SEQ ID NO: 186 - DNA, 48 bp, Artificial sequence
  Recombinant sequence
agaaggtatttatagggattcatattataggcgatataaataccttct

SEQ ID NO: 187 - DNA, 68 bp, Artificial sequence
  Recombinant sequence
agaaggtatttatagcttcgtcctcttaaggtcatgtcttctgtttccacggcgtataaataccttct

SEQ ID NO: 188 - DNA, 50 bp, Artificial sequence
  Recombinant sequence
agaaggtatttatatgatgaattcatcaatcaagcttataaataccttct

SEQ ID NO: 189 - DNA, 40 bp, Artificial sequence
  Recombinant sequence
gcttcgtcctcttaaggtcatgtcttctgtttccacggcg

SEQ ID NO: 190 - DNA, 30 bp, Artificial sequence
  Recombinant sequence
gcttcgtcctcttaaggtcatggtttacag

SEQ ID NO: 191 - DNA, 40 bp, Artificial sequence
  Recombinant sequence
gcttcgtcctcttaaggtcatgtcttctgttggtttacag

SEQ ID NO: 192 - DNA, 40 bp, Artificial sequence
  Recombinant sequence
gatagaacctacacagcaatacgagaaatgtgtaatttgg

SEQ ID NO: 193 - DNA, 29 bp, Artificial sequence
  Recombinant sequence
gatagaacctacacagcaatggtttacag

SEQ ID NO: 194 - DNA, 21 bp, Artificial sequence
  Recombinant sequence
gatagaaccaatggtttacag

SEQ ID NO: 195 - DNA, 20 bp, Artificial sequence
  Recombinant sequence
gggattcatattataggcga

SEQ ID NO: 196 - DNA, 18 bp, Artificial sequence
  Recombinant sequence
gggattcatggtttacag

SEQ ID NO: 197 - DNA, 20 bp, Artificial sequence
  Recombinant sequence
gggattcatatggtttacag

SEQ ID NO: 198 - DNA, 21 bp, Artificial sequence
  Recombinant sequence
gggattcattatggtttacag

SEQ ID NO: 199 - DNA, 23 bp, Artificial sequence
  Recombinant sequence
gggattcatattatggtttacag

SEQ ID NO: 200 - DNA, 22 bp, Artificial sequence
  Recombinant sequence
tgatgaattcatcaatcaagct

SEQ ID NO: 201 - DNA, 21 bp, Artificial sequence
  Recombinant sequence
tgatgaattcatggtttacag

SEQ ID NO: 202 - DNA, 20 bp, Artificial sequence
  Recombinant sequence
cgcccccccatcccccccgc

SEQ ID NO: 203 - DNA, 20 bp, Artificial sequence
  Recombinant sequence
catacatccatacttgtaat

SEQ ID NO: 204 - DNA, 20 bp, Artificial sequence
  Recombinant sequence
aagtgacaaatcttactact

SEQ ID NO: 205 - DNA, 20 bp, Artificial sequence
  Recombinant sequence
cgagccgcgatactatgcta

SEQ ID NO: 206 - DNA, 20 bp, Artificial sequence
  Recombinant sequence
tactctctgattgccggcct

SEQ ID NO: 207 - DNA, 20 bp, Artificial sequence
  Recombinant sequence
cgctcagacatattccgcag

SEQ ID NO: 208 - DNA, 20 bp, Artificial sequence
  Recombinant sequence
ccaaccagtattaaacccac

SEQ ID NO: 209 - DNA, 20 bp, Artificial sequence
  Recombinant sequence
tgaacttgcatcaggcctca

SEQ ID NO: 210 - DNA, 20 bp, Artificial sequence
  Recombinant sequence
cttttttacatcctcacgga

SEQ ID NO: 211 - DNA, 20 bp, Artificial sequence
  Recombinant sequence
atgtcacgcatccctagcgc

SEQ ID NO: 212 - DNA, 20 bp, Artificial sequence
  Recombinant sequence
tgaccgtaaatcctatccgg

SEQ ID NO: 213 - DNA, 20 bp, Artificial sequence
  Recombinant sequence
gcagagattatcctttggat

SEQ ID NO: 214 - DNA, 20 bp, Artificial sequence
  Recombinant sequence
cgtcataccataaacccccg

SEQ ID NO: 215 - DNA, 20 bp, Artificial sequence
  Recombinant sequence
gccgaatagattcccaccct

SEQ ID NO: 216 - DNA, 19 bp, Artificial sequence
  Recombinant sequence
caggtcctatcccttatcc

SEQ ID NO: 217 - DNA, 19 bp, Artificial sequence
  Recombinant sequence
ccctcccttatgacactcc

SEQ ID NO: 218 - DNA, 20 bp, Artificial sequence
  Recombinant sequence
agcctacacatagaatatta

SEQ ID NO: 219 - DNA, 20 bp, Artificial sequence
  Recombinant sequence
taacggtccatcaccgacaa

SEQ ID NO: 220 - DNA, 20 bp, Artificial sequence
  Recombinant sequence
cagtagtatatgtaccgttg

SEQ ID NO: 221 - DNA, 20 bp, Artificial sequence
  Recombinant sequence
agacacttaatctgaggcca

SEQ ID NO: 222 - DNA, 20 bp, Artificial sequence
  Recombinant sequence
cccactaccatctttgcgca

SEQ ID NO: 223 - DNA, 20 bp, Artificial sequence
  Recombinant sequence
gtgagctctattcatacgac

SEQ ID NO: 224 - DNA, 20 bp, Artificial sequence
  Recombinant sequence
gattccccgattcgccactc

SEQ ID NO: 225 - DNA, 20 bp, Artificial sequence
  Recombinant sequence
ctatcgcggatagccctacc

SEQ ID NO: 226 - DNA, 20 bp, Artificial sequence
  Recombinant sequence
ccggcaatcatacgccatac

SEQ ID NO: 227 - DNA, 17 bp, Artificial sequence
  Recombinant sequence
gatgctaaattggcaac

SEQ ID NO: 228 - DNA, 20 bp, Artificial sequence
  Recombinant sequence
accccccctatccagccacg

SEQ ID NO: 229 - DNA, 19 bp, Artificial sequence
  Recombinant sequence
cagccgtcatcccgacgga

SEQ ID NO: 230 - DNA, 20 bp, Artificial sequence
  Recombinant sequence
agccgcgtcatactagatca

SEQ ID NO: 231 - DNA, 20 bp, Artificial sequence
  Recombinant sequence
cgcccccccatcccccccgc

SEQ ID NO: 232 - DNA, 20 bp, Artificial sequence
  Recombinant sequence
ccgccgacgatagatcaacc

SEQ ID NO: 233 - DNA, 20 bp, Artificial sequence
  Recombinant sequence
cctctcccaatttcctacgt

SEQ ID NO: 234 - DNA, 19 bp, Artificial sequence
  Recombinant sequence
ctacctccattccacacgc

SEQ ID NO: 235 - DNA, 20 bp, Artificial sequence
  Recombinant sequence
acctacgctatcacggcatt

SEQ ID NO: 236 - DNA, 20 bp, Artificial sequence
  Recombinant sequence
cgcgcaccaattctcccctc

SEQ ID NO: 237 - DNA, 20 bp, Artificial sequence
  Recombinant sequence
tgacgaaatatattactgcg

SEQ ID NO: 238 - DNA, 20 bp, Artificial sequence
  Recombinant sequence
atgagtaaaattgtacgcga

SEQ ID NO: 239 - DNA, 20 bp, Artificial sequence
  Recombinant sequence
ccccctaacatacattgagt

SEQ ID NO: 240 - DNA, 20 bp, Artificial sequence
  Recombinant sequence
aggatagacatttaaactca

SEQ ID NO: 241 - DNA, 20 bp, Artificial sequence
  Recombinant sequence
ccatctacaatctaaccgcc

SEQ ID NO: 242 - DNA, 20 bp, Artificial sequence
  Recombinant sequence
aagttagatataaggcaatg

SEQ ID NO: 243 - DNA, 20 bp, Artificial sequence
  Recombinant sequence
ttaaagttaattgggagcag

SEQ ID NO: 244 - DNA, 20 bp, Artificial sequence
  Recombinant sequence
ttgccttcgattcagccaca

SEQ ID NO: 245 - DNA, 20 bp, Artificial sequence
  Recombinant sequence
taatctacgattgtccatac

SEQ ID NO: 246 - DNA, 20 bp, Artificial sequence
  Recombinant sequence
tcaaattaaattgtcgaatc

SEQ ID NO: 247 - DNA, 20 bp, Artificial sequence
  Recombinant sequence
cccacgataatttccgaccg

SEQ ID NO: 248 - DNA, 20 bp, Artificial sequence
  Recombinant sequence
cctactccgattcggaaccc

SEQ ID NO: 249 - DNA, 20 bp, Artificial sequence
  Recombinant sequence
acctattatatctaataaac

SEQ ID NO: 250 - DNA, 20 bp, Artificial sequence
  Recombinant sequence
tcttgctgcatcgatcgtcc

SEQ ID NO: 251 - DNA, 20 bp, Artificial sequence
  Recombinant sequence
gggggaagaatcgcctgacg

SEQ ID NO: 252 - DNA, 20 bp, Artificial sequence
  Recombinant sequence
tgaagaataatacatgaata

SEQ ID NO: 253 - DNA, 20 bp, Artificial sequence
  Recombinant sequence
cgacgcgatataccatacct

SEQ ID NO: 254 - DNA, 20 bp, Artificial sequence
  Recombinant sequence
ccacaacccattcgccgccc

SEQ ID NO: 255 - DNA, 20 bp, Artificial sequence
  Recombinant sequence
acccgcgatattggtcgatg

SEQ ID NO: 256 - DNA, 20 bp, Artificial sequence
  Recombinant sequence
aaagcctgaattattggagt

SEQ ID NO: 257 - DNA, 20 bp, Artificial sequence
  Recombinant sequence
cgcacgtaaataaacacgta

SEQ ID NO: 258 - DNA, 20 bp, Artificial sequence
  Recombinant sequence
tctcaaaccatggtttcact

SEQ ID NO: 259 - DNA, 20 bp, Artificial sequence
  Recombinant sequence
tctctaaccatggttacact

SEQ ID NO: 260 - DNA, 20 bp, Artificial sequence
  Recombinant sequence
tctctgaccatggtcacact

SEQ ID NO: 261 - DNA, 20 bp, Artificial sequence
  Recombinant sequence
tccaaaactatagtttacag

SEQ ID NO: 262 - DNA, 20 bp, Artificial sequence
  Recombinant sequence
tccaaaaccaaggtttacag

SEQ ID NO: 263 - DNA, 20 bp, Artificial sequence
  Recombinant sequence
tccaaaacctcggtttacag

SEQ ID NO: 264 - DNA, 20 bp, Artificial sequence
  Recombinant sequence
  misc_feature (1)..(4): n is a, c, g, or t
  misc_feature (17)..(20): n is a, c, g, or t
nnnnaaaccatggtttnnnn

SEQ ID NO: 265 - DNA, 20 bp, Artificial sequence
  Recombinant sequence
  misc_feature (1)..(4): n is a, c, g, or t
  misc_feature (17)..(20): n is a, c, g, or t
nnnnaaaccaaggtttnnnn

SEQ ID NO: 266 - DNA, 20 bp, Artificial sequence
  Recombinant sequence
  misc_feature (1)..(4): n is a, c, g, or t
  misc_feature (17)..(20): n is a, c, g, or t
nnnnaaaccttggtttnnnn

SEQ ID NO: 267 - DNA, 20 bp, Artificial sequence
  Recombinant sequence
  misc_feature (1)..(4): n is a, c, g, or t
  misc_feature (17)..(20): n is a, c, g, or t
nnnnaaacctcggtttnnnn

SEQ ID NO: 268 - DNA, 20 bp, Artificial sequence
  Recombinant sequence
  misc_feature (1)..(4): n is a, c, g, or t
  misc_feature (17)..(20): n is a, c, g, or t
nnnnaaaccgaggtttnnnn

SEQ ID NO: 269 - DNA, 20 bp, Artificial sequence
  Recombinant sequence
  misc_feature (1)..(6): n is a, c, g, or t
  misc_feature (15)..(20): n is a, c, g, or t
nnnnnnaccatggtnnnnnn

SEQ ID NO: 270 - DNA, 20 bp, Artificial sequence
  Recombinant sequence
  misc_feature (1)..(6): n is a, c, g, or t
  misc_feature (15)..(20): n is a, c, g, or t
nnnnnnaccaaggtnnnnnn

SEQ ID NO: 271 - DNA, 20 bp, Artificial sequence
  Recombinant sequence
  misc_feature (1)..(6): n is a, c, g, or t
  misc_feature (15)..(20): n is a, c, g, or t
nnnnnnaccttggtnnnnnn

SEQ ID NO: 272 - DNA, 20 bp, Artificial sequence
  Recombinant sequence
  misc_feature (1)..(6): n is a, c, g, or t
  misc_feature (15)..(20): n is a, c, g, or t
nnnnnnacctcggtnnnnnn

SEQ ID NO: 273 - DNA, 20 bp, Artificial sequence
  Recombinant sequence
  misc_feature (1)..(6): n is a, c, g, or t
  misc_feature (15)..(20): n is a, c, g, or t
nnnnnnaccgaggtnnnnnn

SEQ ID NO: 274 - DNA, 20 bp, Artificial sequence
  Recombinant sequence
tccaaaaccccggtttacag

SEQ ID NO: 275 - DNA, 20 bp, Artificial sequence
  Recombinant sequence
tccaaaaccggggtttacag

SEQ ID NO: 276 - DNA, 20 bp, Artificial sequence
  Recombinant sequence
tccaaaaccaaggtttacag

SEQ ID NO: 277 - DNA, 20 bp, Artificial sequence
  Recombinant sequence
tccaaaaccttggtttacag

SEQ ID NO: 278 - DNA, 20 bp, Artificial sequence
  Recombinant sequence
tccaaaacctcggtttacag

SEQ ID NO: 279 - DNA, 20 bp, Artificial sequence
  Recombinant sequence
gtgagcaccatggagctggc

SEQ ID NO: 280 - DNA, 20 bp, Artificial sequence
  Recombinant sequence
tccaaaaccatggtttacag

SEQ ID NO: 281 - DNA, 8 bp, Artificial sequence
  Recombinant sequence
accatggt

SEQ ID NO: 282 - DNA, 19 bp, Artificial sequence
  Recombinant sequence
tccaaaacctggagctggc

SEQ ID NO: 283 - DNA, 20 bp, Artificial sequence
  Recombinant sequence
  misc_feature (1)..(4): n is a, c, g, or t
  misc_feature (10)..(11): n is a, c, g, or t
  misc_feature (17)..(20): n is a, c, g, or t
nnnnaaaccnnggtttnnnn

SEQ ID NO: 284 - DNA, 20 bp, Artificial sequence
  Recombinant sequence
  misc_feature (1)..(6): n is a, c, g, or t
  misc_feature (10)..(11): n is a, c, g, or t
  misc_feature (15)..(20): n is a, c, g, or t
nnnnnnaccnnggtnnnnnn

SEQ ID NO: 285 - DNA, 12 bp, Artificial sequence
  Recombinant sequence
aaaccaaggttt

SEQ ID NO: 286 - DNA, 12 bp, Artificial sequence
  Recombinant sequence
aaaccttggttt

SEQ ID NO: 287 - DNA, 12 bp, Artificial sequence
  Recombinant sequence
aaaccatggttt

SEQ ID NO: 288 - DNA, 12 bp, Artificial sequence
  Recombinant sequence
aaacctcggttt

SEQ ID NO: 289 - DNA, 12 bp, Artificial sequence
  Recombinant sequence
aaaccgaggttt

SEQ ID NO: 290 - DNA, 12 bp, Artificial sequence
  Recombinant sequence
  misc_feature (6)..(7): n is a, c, g, or t
aaaccnnggttt

SEQ ID NO: 291 - DNA, 25 bp, Artificial sequence
  Recombinant sequence
gtgggatgacgttaattggctctga

SEQ ID NO: 292 - DNA, 25 bp, Artificial sequence
  Recombinant sequence
tgcatgctacacggtgcaagcagcc

SEQ ID NO: 293 - DNA, 25 bp, Artificial sequence
  Recombinant sequence
tggcatgatgaaggcaacatggcca

SEQ ID NO: 294 - DNA, 19 bp, Artificial sequence
  Recombinant sequence
tggtacctctattaggtac

SEQ ID NO: 295 - DNA, 25 bp, Artificial sequence
  Recombinant sequence
tcatactacatgggtcaatagtata

SEQ ID NO: 296 - DNA, 25 bp, Artificial sequence
  Recombinant sequence
tactataataatttgttcgtctgca

SEQ ID NO: 297 - DNA, 19 bp, Artificial sequence
  Recombinant sequence
tgatgaggaaatcgtagga

SEQ ID NO: 298 - DNA, 19 bp, Artificial sequence
  Recombinant sequence
tcggcgggcaccgcagcct

SEQ ID NO: 299 - DNA, 26 bp, Artificial sequence
  Recombinant sequence
ttatccaaaaccatggtttacaggaa

SEQ ID NO: 300 - DNA, 36 bp, Artificial sequence
  Recombinant sequence
taacttcgtataatgtatactatacgaagttatcag

What is claimed is:

1. A DNA construct encoding a chimeric recombinase polypeptide comprising a serine recombinase catalytic domain and a TALE DNA-binding domain comprising at least one repeat-variable di-residue (RVD) DNA-binding repeat domain, wherein said DNA construct further comprises a nucleic acid encoding a first polypeptide linker, wherein the serine recombinase catalytic domain is positioned at a C-terminal position of the chimeric recombinase polypeptide, and wherein the DNA construct comprises a nucleic acid sequence encoding a non-specific DNA-contact domain polypeptide, wherein the DNA-contact domain polypeptide is positioned at the C-terminus of the serine recombinase catalytic domain.

2. The DNA construct of claim 1, wherein the first linker is between the serine recombinase catalytic domain and the TALE DNA-binding domain.

3. The DNA construct of claim 1, wherein the serine recombinase catalytic domain is positioned at an N-terminal position of the chimeric recombinase polypeptide.

4. The DNA construct of claim 1, wherein the serine recombinase catalytic domain comprises a small serine recombinase catalytic domain.

5. The DNA construct of claim 4, wherein the small serine recombinase catalytic domain is a permissive small serine recombinase catalytic domain.

6. The DNA construct of claim 4, wherein the small serine recombinase catalytic domain is a recombinase selected from the group consisting of Gin20H106Y, GinL7C7-EE2, GinL7C7-EE3, HinC, and HinB (HinH106Y).

7. The DNA construct of claim 1, wherein the TALE DNA-binding domain is positioned at a C-terminal position of the chimeric recombinase polypeptide.

8. The DNA construct of claim 1, wherein the TALE DNA-binding domain of said chimeric recombinase polypeptide retains equal or greater binding affinity relative to a TALE DNA-binding domain lacking said recombinase catalytic domain.

9. The DNA construct of claim 1, wherein a first amino acid of the TALE DNA-binding domain begins 40 to about 160 amino acids upstream from a first amino acid of a first at least one RVD DNA-binding repeat domain.

10. The DNA construct of claim 1, wherein a first amino acid of the TALE DNA-binding domain begins 53, 81, 85, 98, 102, 113, 117, 130, 136, or 147 amino acids upstream from a first amino acid of a first at least one RVD DNA-binding repeat domain.

11. The DNA construct of claim 1, wherein the chimeric recombinase polypeptide is a permissive recombinase.

12. The DNA construct of claim 2, wherein the first linker comprises about 4 amino acids to about 30 amino acids.

13. The DNA construct of claim 11, wherein the permissive recombinase comprises:

a) a small serine recombinase catalytic domain of the type GinL7C7-EE2 positioned at the N-terminal position; and
b) a TALE DNA-binding domain positioned at the C-terminal position, wherein a first amino acid of the TALE DNA-binding domain begins 136 amino acids upstream from a first amino acid of the at least one RVD DNA-binding repeat domain.

14. The DNA construct of claim 1, wherein the first linker is between a C-terminus of the TALE DNA-binding domain and an N-terminus of the serine recombinase catalytic domain.

15. The DNA construct of claim 1, wherein the TALE DNA-binding domain is positioned at an N-terminal position of the chimeric recombinase polypeptide.

16. The DNA construct of claim 1, further comprising a nucleic acid sequence encoding a second polypeptide linker, wherein the second linker is between a C-terminus of the serine recombinase catalytic domain and an N-terminus of the non-specific DNA-contact domain.

17. The DNA construct of claim 14, wherein the first linker comprises SEQ ID NO:77 or SEQ ID NO:78.

18. The DNA construct of claim 16, wherein the second linker comprises SEQ ID NO:79.

19. The DNA construct of claim 1, wherein the DNA-contact domain is selected from the group consisting of SEQ ID NO:80, SEQ ID NO:81, SEQ ID NO:82, and SEQ ID NO:83.

20. The DNA construct of claim 1, wherein a first amino acid of the TALE DNA-binding domain begins 40 to about 160 amino acids upstream from a first amino acid of a first at least one RVD DNA-binding repeat domain.

21. The DNA construct of claim 1, wherein a first amino acid of the TALE DNA-binding domain begins 53, 81, 85, 98, 102, 113, 117, 130, 136, or 147amino acids upstream from a first amino acid of a first at least one RVD DNA-binding repeat domain.

22. The DNA construct of claim 1, wherein a first amino acid of the TALE DNA-binding domain begins 136 amino acids upstream from a first amino acid of a first at least one RVD DNA-binding repeat domain.

23. The DNA construct of claim 1, wherein the serine recombinase catalytic domain is positioned at the C-terminus of the TALE DNA-binding domain.

24. The DNA construct of claim 1, wherein the serine recombinase catalytic domain is positioned at a C-terminal truncation site of the TALE DNA-binding domain, wherein the C-terminal truncation site is selected from the group consisting of SEQ ID NO:84, SEQ ID NO:85, and SEQ ID NO:86.

* * * * *